United States Patent
Hicklin et al.

(10) Patent No.: US 10,988,545 B2
(45) Date of Patent: Apr. 27, 2021

(54) ANTI-GITR ANTIGEN-BINDING PROTEINS AND METHODS OF USE THEREOF

(71) Applicant: Potenza Therapeutics, Inc., Cambridge, MA (US)

(72) Inventors: Daniel Hicklin, Montclair, NJ (US); Cynthia Seidel-Dugan, Belmont, MA (US); William Winston, Newton, MA (US); Jose-Andres Salmeron-Garcia, Westminster, MA (US); Heather Brodkin, West Newton, MA (US); Sonja Kleffel, Boston, MA (US); Nels P. Nielson, Lebanon, NH (US)

(73) Assignee: Potenza Therapeutics, Inc., Cambridge, MA (US)

( * ) Notice: Subject to any disclaimer, the term of this patent is extended or adjusted under 35 U.S.C. 154(b) by 0 days.

(21) Appl. No.: 15/900,168

(22) Filed: Feb. 20, 2018

(65) Prior Publication Data
US 2018/0208665 A1 Jul. 26, 2018

Related U.S. Application Data

(63) Continuation of application No. PCT/US2017/062443, filed on Nov. 19, 2017.

(60) Provisional application No. 62/448,644, filed on Jan. 20, 2017, provisional application No. 62/497,428, filed on Nov. 19, 2016.

(51) Int. Cl.
*C07K 16/22* (2006.01)
*C07K 16/28* (2006.01)
*A61K 39/00* (2006.01)

(52) U.S. Cl.
CPC ...... *C07K 16/2878* (2013.01); *C07K 16/2875* (2013.01); *A61K 2039/505* (2013.01); *C07K 2317/34* (2013.01); *C07K 2317/35* (2013.01); *C07K 2317/51* (2013.01); *C07K 2317/515* (2013.01); *C07K 2317/55* (2013.01); *C07K 2317/565* (2013.01); *C07K 2317/75* (2013.01); *C07K 2317/92* (2013.01)

(58) Field of Classification Search
None
See application file for complete search history.

(56) References Cited

U.S. PATENT DOCUMENTS

| | | | |
|---|---|---|---|
| 6,503,184 | B1 | 1/2003 | Ni et al. |
| 9,028,823 | B2 | 5/2015 | Smith et al. |
| 9,376,494 | B2 | 6/2016 | Li et al. |
| 10,487,147 | B2 | 11/2019 | Nastri et al. |
| 2005/0014224 | A1 | 1/2005 | Collins et al. |
| 2006/0002932 | A1 | 1/2006 | Vieweg |
| 2006/0134102 | A1 | 6/2006 | LePage et al. |
| 2007/0098719 | A1 | 5/2007 | Smith et al. |
| 2009/0136494 | A1 | 5/2009 | Ponath et al. |
| 2013/0183321 | A1 | 7/2013 | Smith et al. |

FOREIGN PATENT DOCUMENTS

| | | |
|---|---|---|
| EP | 1955708 A1 | 8/2008 |
| EP | 2343320 B1 | 10/2017 |
| WO | WO 2003/006058 A1 | 1/2003 |
| WO | WO 03/068257 A1 | 8/2003 |
| WO | WO 2004/058183 A2 | 7/2004 |
| WO | WO 2004/107618 A2 | 12/2004 |
| WO | WO 2005/007150 A2 | 1/2005 |
| WO | WO 2005/007190 A1 | 1/2005 |
| WO | WO 2006/105021 A2 | 10/2006 |
| WO | WO 2007/060918 A1 | 5/2007 |
| WO | WO 2009/009116 A2 | 1/2009 |
| WO | WO 2017/096179 A1 | 6/2014 |
| WO | WO 2015/184099 A1 | 12/2015 |
| WO | WO 2016/110267 A1 | 7/2016 |

OTHER PUBLICATIONS

Paul (1993) Fundamental Immunology, #rd edition, pp. 292-295.*
Bendig (1995) Methods: a companion. Methods in Enzymology 8: 83-93.*
MacCallum et al. (1996) J. Mol. Biol. 262: 732-745.*
Casset, Roux, Mouchet, Bes, Chardes, Granier, Mani, Pugniere, Laune, Pau, Kaczorek, Lahana, and Rees. A peptide mimetic of an anti-CD4 monoclonal antibody by rational design. Biochemical and Biophysical Research Communications, 2003. vol. 307, pp. 198-205.*
Skolnick and Fetrow. From genes to protein structure and function: novel applications of computational approaches in the genomic era. Trends in Biotechnology, 2000. vol. 18, pp. 34-39.*
Wu, Nie, Huse, and Watkins. Humanization of a murine monoclonal antibody by simultaneous optimization of framework and CDR residues. Journal of Molecular Biology, 1999. vol. 294, pp. 151-162.*
Agostini, M. et al., "The Glucocorticoid-Induced Tumor Necrosis Factor Receptor-Related Gene Modulates the Response to Candida albicans Infection," Infection and Immunity, Nov. 2005, pp. 7502-7508, vol. 73, No. 11.
Baltz, K.M. et al., Neutralization of Tumor-Derived Soluble Glucocorticoid-Induced TNFR-Related Protein Ligand Increases NK Cell Anti-Tumor Reactivity, Blood, Nov. 1, 2008, pp. 3735-3743, vol. 112, No. 9.
Barbee, S.D. et al., "Development of FPA154, A Novel Tetravalent Anti-GITR Antibody, for the Treatment of Solid Tumors," FivePrime® INHIBRX, Five Prime Therapeutics, Inc., 2017, 1 page.
Baumgartner-Nielsen, J. et al., "Glucocorticoid-Induced Tumor Necrosis Factor Receptor (TIGR) and Its Ligand (GITRL) in Atopic Dermatitis," Acta Derm Venereol, 2006, pp. 393-398, vol. 86.

(Continued)

Primary Examiner — Michael D Pak
(74) Attorney, Agent, or Firm — McCarter & English, LLP; Maria Laccotripe Zacharakis; Joseph A. Ciardi

(57) ABSTRACT

Provided herein are antigen-binding proteins (ABPs) that selectively bind to GITR and its isoforms and homologs, and compositions comprising the ABPs. Also provided are methods of using the ABPs, such as therapeutic and diagnostic methods.

11 Claims, 79 Drawing Sheets
Specification includes a Sequence Listing.

(56) References Cited

OTHER PUBLICATIONS

Belmar, N.A. et al., "Murinization and H Chain Isotype Matching of the Anti-GITR Antibody DTA-1 Reduces Immunogenicity-Mediated Anaphylaxis in C57BL/6Mice," with Supplemental Materials, The Journal of Immunology, Apr. 26, 2017, 15 pages.

Boczkowski, D. et al., "Dendritic Cells Engineered to Secrete Anti-GITR Antibodies Are Effective Adjuvants to Dendritic Cell-Based Immunotherapy," Cancer Gene Therapy, 2009, pp. 900-911, vol. 16.

Borghaei, H. et al., "Nivolumab Versus Docetaxel in Advanced Nonsquamous Non-Small-Cell Lung Cancer," The New England Journal of Medicine, 2015, pp. 1627-1639, vol. 373.

Brunn, N.D. et al., "The Role of Anti-Drug Antibodies in the Pharmacokinetics, Disposition, Target Engagement, and Efficacy of a GITR Agonist Monoclonal Antibody in Mice," The Journal of Pharmacology and Experimental Therapeutics, Mar. 2016, pp. 574-586, vol. 356.

Bulliard, Y. et al., Activating Fc γ Receptors Contribute to the Antitumor Activities of Immunoregulatory Receptor-Targeting Antibodies, J Exp. Med., 2013, pp. 1685-3693, vol. 210, No. 9.

Byrne, A.M. et al., "Identification of Glucocorticoid-Induced TNF Receptor-Related Protein Ligand on Keratinocytes: Ligation by GITR Induces Keratinocyte Chemokine Production and Augments T-Cell Proliferation," Journal of Investigative Dermatology, 2009, pp. 2784-2794, vol. 129.

Chattopadhyay, K. et al., "Assembly and Structural Properties of Glucocorticoid-Induced TNF Receptor Ligand: Implications for Function," PNAS, Dec. 4, 2007, pp. 19452-19457, vol. 104, No. 49.

Chattopadhyay, K. et al., "Evolution of GITRL Immune Function: Murine GITRL Exhibits Unique Structural and Biochemical Properties Within the TNF Superfamily," PNAS, Jan. 15, 2008, pp. 635-640, vol. 105, No. 2.

Cohen, A.D. et al., "Agonist Anti-GITR Antibody Enhances Vaccine-Induced CD8+ T-Cell Responses and Tumor Immunity," Cancer Res., May 1, 2006, pp. 4904-4912, vol. 66, No. 9.

Cohen, A.D. et al., "Agonist Anti-GITR Monoclonal Antibody Induces Melanoma Tumor Immunity in Mice by Altering Regulatory T Cell Stability and Intra-Tumor Accumulation," PLoS ONE, May 2010, pp. 1-12, vol. 5, Issue 5, e10436.

Esparza, E.M. et al., "Glucocorticoid-Induced TNF Receptor Functions as a Costimulatory Receptor That Promotes Survival in Early Phases of T Cell Activation," 2005, pp. 7869-7874, vol. 174.

Gan, X. et al., "Correlation of Increased Blood Levels of GITR and GITRL with Disease Severity in Patients with Primary Sjögren's Syndrome," Clinical and Developmental Immunology, 2013, pp. 1-10, vol. 2013, Article ID 340751.

Gao, J. et al., "Advances in the Development of Cancer Immunotherapies," Trends in Immunology, Feb. 2013, pp. 90-98, vol. 34, No. 2.

Gaudreau, M-C. et al., Poster: "Examining the Dynamic Regulation of OX40 Following Receptor Agonism and T-Cell Activation: Implications for Antibody-Mediated Enhancement of T-Cell Function," Presented at the American Association for Cancer Research (AACR) Annual Meeting, Apr. 14-18, 2018, 1 page.

Guney, A.L. et al., "Identification of a New Member of the Tumor Necrosis Factor Family and Its Receptor, a Human Ortholog of Mouse GITR," Current Biology, 1999, pp. 215-218, vol. 9.

Hanabuchi, S. et al., "Human Plasmacytoid Predendritic Cells Activate NK Cells Through Glucocorticoid-Induced Tumor Necrosis Factor Receptor-Ligand (GITRL)," Blood, May 1, 2006, pp. 3617-3623, vol. 107, No. 9.

Ji, H-B. et al., "Cutting Edge: The Natural Ligand for Glucocorticoid-Induced TNF Receptor-Related Protein Abrogates Regulatory T Cell Suppression," The Journal of Immunology, 2004, pp. 5823-5827, vol. 172.

Joetham, A. et al., "Loss of T Regulatory Cell Suppression Following Signaling Through Glucocorticoid-Induced Tumor Necrosis Receptor (GITR) Is Dependent on c-Jun N-Terminal Kinase Activation," The Journal of Biological Chemistry, May 18, 212, pp. 17100-17108, vol. 287, No. 21.

Kanamaru, F. et al., "Costimulation Via Glucocorticoid-Induced TNF Receptor in Both Conventional and CD25+ Regulatory CD4+ T Cells," The Journal of Immunology, 2004, pp. 7306-7314, vol. 172.

Kim, J.I. et al., "Blockade of GITR-GITRL Interaction Maintains Treg Function to Prolong Allograft Survival," European Journal of Immunology, 2010, pp. 1369-1374, vol. 40.

Kim, J.D. et al., "Cloning and Characterization of GITR Ligand," Genes and Immunity, 2003, pp. 564-569, vol. 4.

Kim, W-J. et al., "Glucocorticoid-Induced Tumour Necrosis Factor Receptor Family Related Protein (GITR) Mediates Inflammatory Activation of Macrophages That Can Destabilize Atherosclerotic Plaques," Immunology, 2006, pp. 421-429, vol. 119.

Kim, I-K. et al., "Glucocorticoid-Induced Tumor Necrosis Factor Receptor-Related Protein Co-Stimulation Facilitates Tumor Regression by Inducing IL-9-Producing Helper T Cells," Nature Medicine, Sep. 2015, pp. 1010-1019, vol. 21, No. 9.

Knee, D.A. et al., "Rationale for Anti-GITR Cancer Immunotherapy," European Journal of Cancer, 2016, pp. 1-10, vol. 67.

Ko, K. et al., "Treatment of Advanced Tumors with Agonistic Anti-GIR mAB and Its Effects on Tumor-Infiltrating Foxp3+CD25+CD4+ Regulatory T Cells," The Journal of Experimental Medicine, Rockefeller University Press, Oct. 3, 2005, pp. 885-891, vol. 202, No. 7.

Kohm, A.P. et al., "Cutting Edge: Ligation of the Glucocorticoid-Induced TNF Receptor Enhances Autoreactive CD4+ T Cell Activation and Experimental Autoimmune Encephalomyelitis," The Journal of Immunology, 2004, pp. 4686-4690, vol. 172.

Kwon, B. et al., "Identification of a Novel Activation-Inducible Protein of the Tumor Necrosis Factor Receptor Superfamily and Its Ligand," The Journal of Biological Chemistry, Mar. 5, 1999, pp. 6056-6061, vol. 274, No. 10.

Liao, G. et al., "GITR Engagement Preferentially Enhances Proliferation of Functionally Competent CD4+CD25+FoxP3+ Regulatory T Cells," International Immunology, 2010, pp. 259-270, vol. 22, No. 4.

Liu, B. et al., "Glucocorticoid-Induced Tumor Necrosis Factor Receptor Negatively Regulates Activation of Human Primary Natural Killer (NK) Cells by Blocking Proliferative Signals and Increasing NK Cell Apoptosis," The Journal of Biological Chemistry, Mar. 28, 2008, pp. 8202-8210, vol. 283, No. 13.

Liu, Y. et al., "Novel Tumor Suppressor Function of Glucocorticoid-Induced TNF Receptor GITR in Multiple Myeloma," PLoS One, Jun. 2013, pp. 1-14, vol. 8, Issue 6, e66982.

Lu, L. et al., "Combined PD-1 Blockade and GITR Triggering Induce a Potent Antitumor Immunity in Murine Cancer Models and Synergizes with Chemotherapeutic Drugs," Journal of Translational Medicine, 2014, pp. 1-11, vol. 12, No. 36.

Mahesh, S.P. et al., "Expression of GITR Ligand Abrogates Immunosuppressive Function of Ocular Tissue and Differentially Modulates Inflammatory Cytokines and Chemokines," European Journal of Immunology, 2006, pp. 2128-2138, vol. 36.

McHugh, R.S. et al., "CD4+CD25+ Immunoregulatory T Cells: Gene Expression Analysis Reveals a Functional Role for the Glucocorticoid-Induced TNF Receptor," Immunity, Feb. 2002, pp. 311-323, vol. 16.

Melero, I. et al., "Agonist Antibodies to TNFR Molecules That Cosimulate T and NK Cells," (includes Correction), CCR Focus, Clinical Cancer Research, Mar. 1, 213, pp. 1044-1053, vol. 19, No. 5.

Mitsui, J. et al., "Two Distinct Mechanisms of Augmented Antitumor Activity by Modulation of Immunostimulatory/Inhibitory Signals," Clinical Cancer Research, 2010, pp. 2781-2791, vol. 16.

Moore, T.C. et al., "B Cell Requirement for Robust Regulatory T Cell Responses to Friend Retrovirus Infection," American Society for Microbiology, mBio, Jul./Aug. 2017, pp. 1-13, vol. 8, Issue 4, e01122-17.

Murphy, J.T. et al., "Anaphylaxis Caused by Repetitive Doses of a GITR Agonist Monoclonal Antibody in Mice," Immunobiology, Blood, Apr. 3, 2014, pp. 2172-2180, vol. 123, No. 14.

(56) References Cited

OTHER PUBLICATIONS

Nakagawa, H. et al., "Instability of Helios-Deficient Tregs is Associated with Conversion to a T-Effector Phenotype and Enhanced Antitumor Immunity," PNAS Early Edition, 2016, pp. 1-7.
Nishikawa, H. et al., "Regulatory T Cell-Resistant CD8+ T Cells Induced by Glucocorticoid-Induced Tumor Necrosis Factor Receptor Signaling," Cancer Research, Jul. 15, 2008, pp. 5948-5954, vol. 68, No. 14.
Nocentini, G. et al., "GITR/GITRL: More Than an Effector T Cell Co-Stimulatory System," European Journal of Immunology Highlights, 2007, pp. 1165-1169, vol. 37.
Nocentini, G. et al., "Pharmacological Modulation of GITR/GITR System: Therapeutic Perspectives," British Journal of Pharmacology, Mar. 9, 2012, pp. 2089-2099, vol. 165, No. 7, 9.
Pascutti, M.F. et al., "Enhanced CD8 T Cell Responses Through GITR-Mediated Costimulation Resolve Chronic Viral Infection," PLOS Pathogens, Mar. 4, 2015, pp. 1-23.
PCT International Search Report and Written Opinion, PCT Application No. PCT/US2017/062443, dated Mar. 20, 2018, 24 pages.
Placke, T. et al., "Glucocorticoid-Induced TNFR-Related (GITR) Protein and Its Ligand in Antitumor Immunity: Functional Role and Therapeutic Modulation," Hindawi Publishing Corporation, Clinical and Developmental Immunology, 2010, pp. 1-10, vol. 2010, Article ID 239083.
Ramirez-Montagut, T. et al., "Glucocorticoid-Induced TNF Receptor Family Related Gene Activation Overcomes Tolerance/Ignorance to Melanoma Differentiation Antigens and Enhances Antitumor Immunity," The Journal of Immunology, 2006, pp. 6434-6442, vol. 176.
Rojko, J.L. et al., "Formation, Clearance, Deposition, Pathogenicity, and Identification of Biopharmaceutical-Related Immune Complexes: Review and Case Studies," Toxicologic Pathology, 2014, pp. 725-764, vol. 42.
Ronchetti, S. et al., "Glucocorticoid-Induced Tumour Necrosis Factor Receptor-Related Protein: A Key Marker of Functional Regulatory T Cells," Hindawi Publishing Corporation, Journal of Immunology Research, 2015, pp. 1-18, vol. 2015, Article ID 171520.
Schaer, D.A. et al., "GITR Pathway Activation Abrogates Tumor Immune Suppression Through Loss of Regulatory T Cell Lineage Stability," Cancer Immunol Res., Nov. 1, 213, pp. 1-18, vol. 1, No. 5.
Schaer, D.A. et al., "Modulation of GITR for Cancer Immunotherapy," Current Opinion in Immunology, Apr. 2012, pp. 217-224, vol. 24, No. 2.
Schaer, D.A. et al., "Targeting Tumor-Necrosis Factor Receptor Pathways for Tumor Immunotherapy," Journal for ImmunoTherapy of Cancer, 2014, pp. 1-9, vol. 2, No. 7.
Schmiedel, B.J. et al., "Generation and Preclinical Characterization of a Fc-Optimized GITR-Ig Fusion Protein for Induction of NK Cell Reactivity Against Leukemia," Molecular Therapy, pp. 877-886, vol. 21, No. 4.
Scirka, B. et al., "Anti-GITR Antibody Treatment Increases TCR Repertoire Diversity of Regulatory But Not Effector T Cells Engaged in the Immune Response Against B16 Melanoma," Arch. Immunol. Ther. Exp., Jun. 21, 2017, pp. 1-12.
Scumpia, P.O. et al., "Treatment with GITR Agonistic Antibody Corrects Adaptive Immune Dysfunction in Sepsis," Aug. 9, 2007, [Online] [Retrieved on Feb. 28, 2018] Retrieved from the Internet<URL:http://www.bloodjournal.org/content/110/10/3673.full.pdf>.
Shimizu, J. et al., "Stimulation of CD25+CD4+ Regulatory T Cells Through GITR Breaks Immunological Self-Tolerance," Nature Immunology, Feb. 2002, pp. 135-142, vol. 3, No. 2.
Sinik Teodorovic, L. et al., "Murine B Cell Development and Antibody Responses to Model Antigens Are Not Impaired in the Absence of the TNF Receptor GITR," PLoS One, Feb. 2012, pp. 1-13, vol. 7, Issue 2.
Snell, L.M. et al., "CD8 T Cell-Intrinsic GITR Is Required for T Cell Clonal Expansion and Mouse Survival Following Sever Influenza Infection," The Journal of Immunology, 2010, pp. 7223-7234, vol. 185.
Stephens, G.L. et al., "Engagement of Glucocorticoid-Induced TNFR Family-Related Receptor on Effector T Cells by its Ligand Mediates Resistance to Suppression by CD4+ CD25+ T Cells," The Journal of Immunology, 2004, pp. 5008-5020, vol. 173.
Stewart, R. et al., "The Role of Fc Gamma Receptors in the Activity of Immunomodulatory Antibodies for Cancer," Journal for ImmunoTherapy of Cancer, 2014, pp. 1-10, vol. 2, No. 29.
Sukumar, S. et al., "Characterization of MK-4166, A Clinical Agonistic Antibody That Targets Human GITR and Inhibits the Generation and Suppressive Effects of T Regulatory Cells," Cancer Research, American Association for Cancer Research, Jun. 13, 2017, pp. 1-33.
Tone, M. et al., "Mouse Glucocorticoid-Induced Tumor Necrosis Factor Receptor Ligand is Costimulatory for T Cells," PNAS, Dec. 9, 2003, pp. 15059-15064, vol. 100, No. 25.
Valzasina, B. et al., "Triggering of OX40 (CD134) on CD4+ CD25+ T Cells Blocks Their Inhibitory Activity: A Novel Regulatory Role for OX40 and Its Comparison with GITR," Blood, Apr. 1, 2005, pp. 2845-2851, vol. 105, No. 7.
Wang, J. et al., "Glucocorticoid-Induced Tumor Necrosis Factor Receptor Is a $p21^{Cpi/WAF1}$ Transcriptional Target Conferring Resistance of Keratinocytes to UV Light-Induced Apoptosis," The Journal of Biological Chemistry, Nov. 11, 2005, pp. 37725-37731, vol. 280, No. 45.
Wyzgol, A. et al., "Trimer Stabilization, Oligomerization, and Antibody-Mediated Cell Surface Immobilization Improve the Activity of Soluble Trimers of CD27L, CD40L, 41BBL, and Glucocorticoid-Induced TNF Receptor Ligand," The Journal of Immunology, 2009, pp. 1851-1861, vol. 183.
Zelenika, D. et al., "Rejection of H-Y Disparate Skin Grafts by Monospecific CD4+ Th1 and Th2 Cells: No Requirement for CD8+ T Cells or B Cells," The Journal of Immunology, 1998, pp. 1868-1874, vol. 161.
Zhou, Z. et al., "Human Glucocorticoid-Induced TNF Receptor Ligand Regulates Its Signaling Activity Through Multiple Oligomerization States," PNAS, Apr. 8, 2008, pp. 5465-5470, vol. 105, No. 14.
Zhou, P. et al., "Pivotal Roles of CD4+ Effector T Cells in Mediating Agonistic Anti-GITR mAb-Induced-Immune Activation and Tumor Immunity in CT26 Tumors," The Journal of Immunology, 2007, pp. 7365-7375, vol. 179.
Zhou, Z. et al., "Structural Basis for Ligand-Mediated Mouse GITR Activation," PNAS, Jan. 15, 2008, pp. 641-645, vol. 105, No. 2.
Abstract of 'Shimizu, J. et al., "Stimulation of CD25(+)CD4(+) Regulatory T Cells Through GITR Breaks Immunological Self-Tolerance," Nat. Immunol., Feb. 2002, pp. 135-142, vol. 3, No. 2,' 1 page.
Abraham, J. et al., "Pharmacogenetics of Cancer Chemotherapy", BBA Reviews on Cancer, Biochimica et Biophysica Acta, 2006, pp. 168-183, vol. 1766, No. 2.
Barrett, S.V. et al., "Conventional Chemotherapeutics," The Cancer Handbook, 2nd ed., John Wiley & Sons, Ltd., 2007, pp. 1-8.
Berenbaum, M.C., "Synergy, Additivism and Antagonism in Immunosuppression" Clin Exp Immunol, 1977, pp. 1-18, vol. 28.
Beyer, M. et al., "Reduced Frequencies and Suppressive Function of CD4+ and CD25hi Regulatory T Cells in Patients with Chronic Lymphocytic Leukemia After Therapy with Fludarabine," Blood, Sep. 15, 2005, pp. 2018-2025, vol. 106, No. 6.
Beyer, M. et al., "Regulatory T Cells in Cancer" Blood, Aug. 1, 2006, pp. 804-811, vol. 108, No. 3.
Brattain, M.G. et al., "Establishment of Mouse Colonic Carcinoma Cell Lines with Different Metastatic Properties," Cancer Research, Jul. 1980, pp. 2142-2146, vol. 40.
Buechele, C. et al., "Glucocorticoid-Induced TNFR-Related Protein (GITR) Ligand Modulates Cytokine Release and NK Cell Reactivity in Chronic Lymphocytic Leukemia (CLL)," Leukemia, 2012, pp. 991-1000, vol. 26.
Chabner, B.A. et al., "Chemotherapy and the War on Cancer," Nature Revies Cancer, Jan. 2005, pp. 65-72, vol. 5.

(56) References Cited

OTHER PUBLICATIONS

Cho, K-H. et al., "Decrease in Intestinal Endocrine Cells in Balb/c Mice with CT-26 Carcinoma Cells," J Vet. Sci., 2008, pp. 9-14, vol. 9, No. 1.
Chong, G. et al., "Combining Cancer Vaccines with Chemotherapy" Expert Opinion on Pharmacotherapy, 2005, pp. 2813-2820, vol. 6, No. 16.
Chou, T.-C., "Theoretical Basis, Experimental Design, and Computerized Simulation of Synegism and Antagonism in Drug Combination Studies," Pharmacological Reviews, 2006, pp. 621-681, vol. 58, No. 3.
Clinical Trial NCT00351325, U.S. National Institutes of Health, Received Jul. 11, 2006, Last Verified Sep. 2009, 3 pages.
Cohen, Adam et al. "Synergistic Tumor Immunity Induced by Chemotherapy and Agonist Anti-GITR Antibody" Blood, vol. 110, No. 11, 2007.
Cohen, "An Agonist Anti-GITR Antibody Enhances Effector and Memory CD8 T Cell Responses and Tumor Immunity Following Xenogenic DNA Immunization Against Melanoma" Proceedings of the American Association for Cancer Research Annual Meeting, 2005, 2 pages.
Cohen, "Agonist Anti-GITR Antibody Enhances Effector and Memory CD8+ T Cell Responses and Tumor Immunity," Cancer Research May 1, 2006, pp. 4904-4912, vol. 66, No. 9.
Curiel, T. J. "Tregs and Rethinking Cancer Immunotherapy," The Journal of Clinial Investigation, May 2007, pp. 1167-1174, vol. 117, No. 5.
De Jonge, M. E. et al., "Clinical Pharmacokinetics of Cyclophosphamide," Clinical Pharmacokinetics, 2005, pp. 1135-1164, vol. 44, No. 11.
Dyall, R. et al., "Heterclitic Immunization Induces Tumor Immunity" J Exp. Med., Nov. 2, 1998, pp. 1553-1561, vol. 188, No. 9.
EBiosciences DTA-1 Product Information Sheet, Affymetrix Bioscience, Thermo Fischer Scientific Inc., 2017, 2 pages.
Eralp, Y. et al., "Doxorubicin and Paclitaxel Enhance the Antitumor Efficacy of Vaccines Directed Against HER 2/neu in a Murine Mammary Carcinoma Model," Breast Cancer Res, 2004, pp. R275-R283, vol. 6.
Frumento, G. et al., "Targeting Tumor-Related Immunosuppression for Cancer Immunotherapy," Endocrine, Metabolic & Immune Disorders-Drug Targets (Formerly Current Drug Targets—Immune, Endocrine & Metabolic Disorders), 2006, pp. 223-237, vol. 6, No. 3.
Gaffney, M.C. et al., "DNA Vaccination Targeting Mesothelin Combined with Anti-GITR Antibody Induces Rejection of Pancreatic Adenocarcinoma," Proceedings of the American Association for Cancer Research Annual Meeting, 2006, 2 pages, vol. 47.
Ghiringhelli, F. et al., "CD4+CD25+Regulatory T Cells Suppress Tumor Immunity but are Sensitive to Cyclophosphamide Which Allows Immunotherapy of Established Tumors to be Curative," Eur J Immunol., 2004, pp. 336-344, vol. 34.
Grem, J.L. et al., "Mechanisms of Action of Cancer Chemotherapeutic Agents: Antimetabolites," The Cancer Handbook. John Wiley & Sons, Ltd., 2005, pp. 1271-1293.
Hanabuchi, S. et al., "Human Plasmacytoid Predentritic Cells Activate NK Cells Through Glucocorticoid-Induced Tumor Necrosis Factor Receptor-Ligand (GITRL)," Blood, May 1, 2006, pp. 3617-3623, vol. 107, No. 9.
Hennequin, C. et al., "Biological Basis for Chemo-Radiotherapy Interactions," European Journal of Cancer, 2002, pp. 223-230, vol. 38.
Herber. D.L. et al, "Meeting Report: Mechanism and Therapeutic Reversal of Immune Suppression in Cancer," Cancer Research, 2007, pp. 5067-5069, vol. 67, No. 11.
Herber, D.L. et al., "Mechanism and Therapeutic Reversal of Immune Suppression in Cancer," Cancer Research, Jun. 1, 2007, pp. 5067-5069, vol. 67, No. 11.
Honore, S et al. "Synergistic Suppression of Microtubule Dynamics by Discodermolide and Paditaxel in Non-Small Cell Lung Carcinoma Cells," Cancer Research, Jul. 15, 2004, pp. 4957-4964, vol. 64.
Kang, C-Y., "Combined Chem-Immunotherapy Can Efficiently Break Self-Tolerance and Induce Anti-Tumor Immunity in a Tolerogenic Murine Tumor Model," Seoul National University, 20 pages.
Ko, H-J. et al, "A Combination of Chermoimmunotherapies Can Efficiently Break Self-Tolerance and Induce Antitumor Immunity in a Tolerogenic Murine Tumor Model," Cancer Research, 2007, pp. 7477-7486, vol. 67, No. 15.
Ko, K. et al., "Treatment of Advanced Tumors With Agonistic Anti-GITR mAb and Its Effects on Tumor-Infiltrating Foxp3+CD25+ CD4+ Regulatory T Cells," The Journal of Experimental Medicine, Oct. 3, 2005, pp. 885-891, vol. 202, No. 7.
Abstract of Ko, H-J. et al., "Combined Chemoimmunotherapy Can Efficiently Break Self-Tolerance and Induce Anti-Tumor Immunity in a Tolergenic Murine Tumor Model," p. 89.
Lake, R.A. et al., "Immunotherapy and Chemotherapy—a Practical Partnership" Nature Reviews Cancer, May 2005, pp. 397-405, vol. 5, No. 5.
Le, D.T. et al., "Regulatory T Cell Modulation Using Cyclophosphamide in Vaccine Approaches: A Current Perspective," Cancer Res., 2012, pp. 3439-3444, vol. 72, No. 14.
Lenz, H-J., "Antiangiogenetic Agents in Cancer Therapy." Oncology, Apr. 3, 2005, pp. 17-25, vol. 4 (Suppl 3).
Livertox Drug Record on "Trimetraxate," U.S. National Library of Medicine, Last Updated Dec. 6, 2016, 4 pages.
Lutsiak, M.E. et al., "Inhibition of CD4+25_+T Regulatory Cell Function Implicated in Enhanced Immune Response by Low-Dose Cyclophosphamide" Blood, Apr. 1, 2005, pp. 2862-2868, vol. 105, No. 7.
Machiels, J.P. et al., "Cyclophosphamide, Doxorubicin, and Paclitaxel Enhance the Antitumor Immune Response of Granulocyte/Macrophage-Colony Stimulating Factor-Secreting Whole-Cell Vacccine in HER 2/neu Tolerized Mice," Cancer Research, May 1, 2001, pp. 3689-3697, vol. 61, No. 9.
Markasz, L. et al., "Effect of Frequently Used Chemotherapeutic Drugs on the Cytotoxic Activity of Human Natural Killer Cells," Mol. Cancer Ther., 2007, pp. 644-654, vol. 6, No. 2.
McMillin, D.W. et al., "Complete Regression of Large Solid Tumors Using Engineered Drug-Resistant Hematopoietic Cells and Anti-CD137 Immunotherapy," Human Gene Therapy, Aug. 2006, pp. 798-806, vol. 17.
Melero, I. et al., "Immunostimulatory Monoclonal Antibodies for Cancer Therapy," Nature Reviews Cancer, Feb. 2007, pp. 95-106, vol. 7.
Mokyr, M.B. et al., "Realization of the Therapeutic Potential of CTLA-4 Blockade in Low-Dose Chemotherapy-Treated Tumor-Bearing Mice" Cancer Research, American Association for Cancer Research, Dec. 1, 1998, pp. 5301-5304, vol. 58.
Nocentini, G. et al., "GITR: A Multifaceted Regulator of Immunity Belonging to the Tumor Necrosis Factor Receptor Superfamily," Eur. J. Immunol., 2005, pp. 1016-1022, vol. 35.
Nocentini, G. et al, "Pharmacological Modulation of GITRL/GITR System: Therapeutic Perspectives," British Journal of Pharmacology, 2012, pp. 2089-2099, vol. 165.
Nocentini, G. et al., "A New Member of the Tumor Necrosis Factor/Nerve Growth Factor Receptor Family Inhibits T Cell Receptor-Induced Apoptosis," Proc. Natl. Acad. Sci., USA, Jun. 1997, pp. 6216-6221, vol. 94.
Nowak, A.K. et al., "Induction of Tumor Cell Apoptosis in Vivo Increases Tumor Antigen Cross-Presentation, Cross-Priming Rather than Cross-Tolerizing Host Tumor-Specific CD8 T Cells" The Journal of Immunology, 2003, pp. 4908-4913.
Nowak, A.K. et al., "Synergy Between Chemotherapy and Immunotherapy in the Treatment of Established Murine Solid Tumors," Cancer Research American Association for Cancer Research, Aug. 1, 2003, pp. 4490-4496, vol. 6.
Nowak, A.K. et al., "Gemcitabine Exerts a Selective Effect on the Humoral Immune Response: Implications for Combination Chemo-Immunotherapy" Cancer Research, Apr. 15, 2002, pp. 2353-2358, vol. 62.

(56) References Cited

OTHER PUBLICATIONS

Nowak, A.K. et al., "Combined Chemoimmunotherapy of Solid Tumours: Improving Vaccines?" Advanced Drug Delivery Reviews, 2006, pp. 975-990, vol. 58.
Pauwels, B. et al., "Combined Modality Therapy of Gemcitabine and Radiation," The Oncologist, 2005, pp. 34-51, vol. 10.
Pearlstein, E. et al., "Effect of Antiplatelet Antibody on the Development of Pulmonary Metasteses Following Injection of CT26 Colon Adenocarcinoma, Lewis Lung Carcinoma, and B16 Amelanotic Melanoma Tumor Cells into Mice," Cancer Research, Sep. 1984, pp. 3884-3887, vol. 44.
Peters, G.J. et al., "Basis for Effective Combination Cancer Chemotherapy with Antimetabolites," Pharmacology & Therapeutics, 2000, pp. 227-253, vol. 87.
Ramakrishnan, R. et al., "Novel Mechanism of Synergistic Effects of Conventional Chemotherapy and Immune Therapy of Cancer." Cancer Immunology, Immunotherapy, 2013, pp. 405-410, vol. 62.
Ramirez-Montagut, T. et al., "Glucocorticoid-Induced TNF Receptor Family Gene Activation Overcomes Tolerance/Ignorance to Melanoma Differentiation Antigens and Enhances Antitumor Immunity," The Journal of Immunology, 2006, pp. 6434-6442, vol. 176.
Research Offers Hope of Cure for Mesothelioma, Nov. 25, 2004 May be Retrieved at<URL:http://www.smh.com.au/news/Health/Research-offers-hope-of-cure-for-mesothelioma/2004/11/24/1101219620087.html>.
Rios-Doria, J. et al, "Doxil Synergizes with Cancer Immunotherapies to Enhance Antitumor Responses in Syngeneic Mouse Models," Neoplasia, 2015, pp. 661-670, vol. 17, No. 8.
Rubinfeld, B. et al, "Identification and Immunotherapeutic Targeting of Antigens Induced by Chemotherapy," Nature Biotechnology, Feb. 2006, pp. 205-209, vol. 24, No. 2.
Santini, V. et al., "Apoptotic and Antiproliferative Effects of Gemcitabine and Gemcitabine Plus ARA-C on Blast Cells from Patients with Blast Crisis Chronic Myeloproliferative Disorders," Haematologia, 1997, pp. 11-15, vol. 82.
Scagliotti, G.V. et al., "Antimetabolites and Cancer: Emerging Data with a Focus on Antifolates," Expert Opinion on Therapeutic Patients, 2006, pp. 189-200, vol. 16, No. 2.
Shimizu, J. et al., "Stimulation of the CD25+CD4+ Regulatory T Cells Through GITR Breaks Immunological Self-Tolerance," Nature Immunology, Feb. 2002, pp. 135-142, vol. 3, No. 2.
Slides Presented at the Conference Titled "Mechanism and Therapeutic Reversal of Immune Suppression in Cancer" at H. Lee Moffitt Cancer 8 Research Institute, which took place from Jan. 25-28, 2007, 12 pages.
Stebbings, R. et al., ""Cytokine Storm" in the Phase I Trial of Monclonal Antibody TGN1412: Better Understanding the Causes to Improve PreClinical Testing of Immunotherapeutics," The Journal of Immunology, 2007, pp. 3325-3331, vol. 179.
Suzuki, E. et al., "Gemcitabine Selectively Eliminates Splenic Gr-1+/CD11b+ Myeloid Suppressor Cells in Tumor-Bearing Animals and Enhances Antitumor Immune Activity," Clin Cancer Res, Sep. 15, 2005, pp. 6713-6721, vol. 11, No. 18.
TolerRx, Inc., "Agonistic Antibodies to Human Glucocorticoid-Induced Tumor Necrosis Factor Receptor as Potential Stimulators of T Cell Immunity for the Treatment of Cancer and Viral Infections," Expert Opin. Ther. Patents, pp. 567-575, vol. 17, No. 5.
Trendowski, M., "The Inherent Metastasis of Leukaemia and its Exploitation by Sonodynamic Therapy," Critical Reviews in Oncology/Hematology, 2015, pp. 149-163, vol. 95.
Tsurushita, N. et al., "Design of Humanized Antibodies: From Anti-Tac to Zenapax," Methods, 2005, pp. 69-83, vol. 36.
Turk, M.J. et al., "Concomitant Tumor Immunity to a Poorly Immunogenic Melanoma is Prevented by Regulatory T Cells," The Journal of Experimental Medicine, Sep. 20, 2004, pp. 771-782, vol. 200, No. 6.
Tuve, S. et al, "Combination of Tumor Site-Located CTL Associated Antigen-4 Blockade and Systemic Regulatory T-Cell Depletion Induces Tumor Destructive Immune Responses," Cancer Research, Jun. 15, 2007, pp. 5929-5939, vol. 67, No. 12.
Uno, T. et al., "Eradication of Established Tumors in Mice by a Combination of Antibody-Based Therapy," Nature Medicine, Jun. 2006, pp. 693-698, vol. 12, No. 6.
Utsugi, T. et al., "Synergistic Antitumor Effects of Topoisomerase Inhibitors and Natural Cell-Mediated Cytotoxicity," Cancer Research, 1989, pp. 1429-1433, vol. 49.
Van Der Most, R.G. "Combining Immunotherapy with Chemotherapy to Treat Cancer," Discovery Medicine, Jun. 2005, pp. 265-270, vol. 5, No. 27.
Watts, T.H., "TNF/TNFR Family Members in Costimulation of T Cell Responses," Annu. Rev. Immunol., 2005, pp. 23-68, vol. 23.
Weir, G.W. et al., "Immune Modulation by Chemotherapy or Immunotherapy to Enhance Cancer Vaccines," Cancers, 2011, pp. 3114-3142, vol. 3.
Willett, C.G. et al., "Direct Evidence That the VEGF-Specific Antibody Bevacizumab has Antivascular Effects in Human Rectal Cancer," Nat Med., 2004, pp. 145-147, vol. 10, No. 2.
Wolf, D. et al., "Regulatory T Cells in Cancer Biology: A Possible New Target for Biochemical Therapies," Mini Reviews in Medicinal Chemistry, 2006, pp. 509-513, vol. 6, No. 5.
Yamaguchi, T. et al.., "Regulatory T Cells in Immune Surveillance and Treatment of Cancer," Seminars in Cancer Biology, 2006, pp. 115-123, vol. 16, No. 2.
Yang, Y. et al, "Anti-GITR Antibody Inhibits L615 Leukemia in a Mouse," Acta Academie Medicinae Militaris Tertiae, 2006, pp. 1837-1839, vol. 28, No. 18.
Yu, N. et al, "Synergistic Antitumor Responses by Combined GITR Activation and Sunitinib in Metastatic Renal Cell Carcinoma," International Journal of Cancer, 2015, pp. 451-462, vol. 138.
Zhou, P. et al., "Pivotal Roles of CD4+ Effector T Cells in Mediating Agonistic Anti-GITR mAb-Induced-Immune Activation and Tumor Immunity in CT26 Tumors," The Journal of Immunology, 2007, pp. 7365-7375.
Zou, W., "Regulatory T Cells, Tumour Immunity and Immunotherapy," Nature Reviews Immunology, Apr. 2006, pp. 295-307, vol. 6.

* cited by examiner

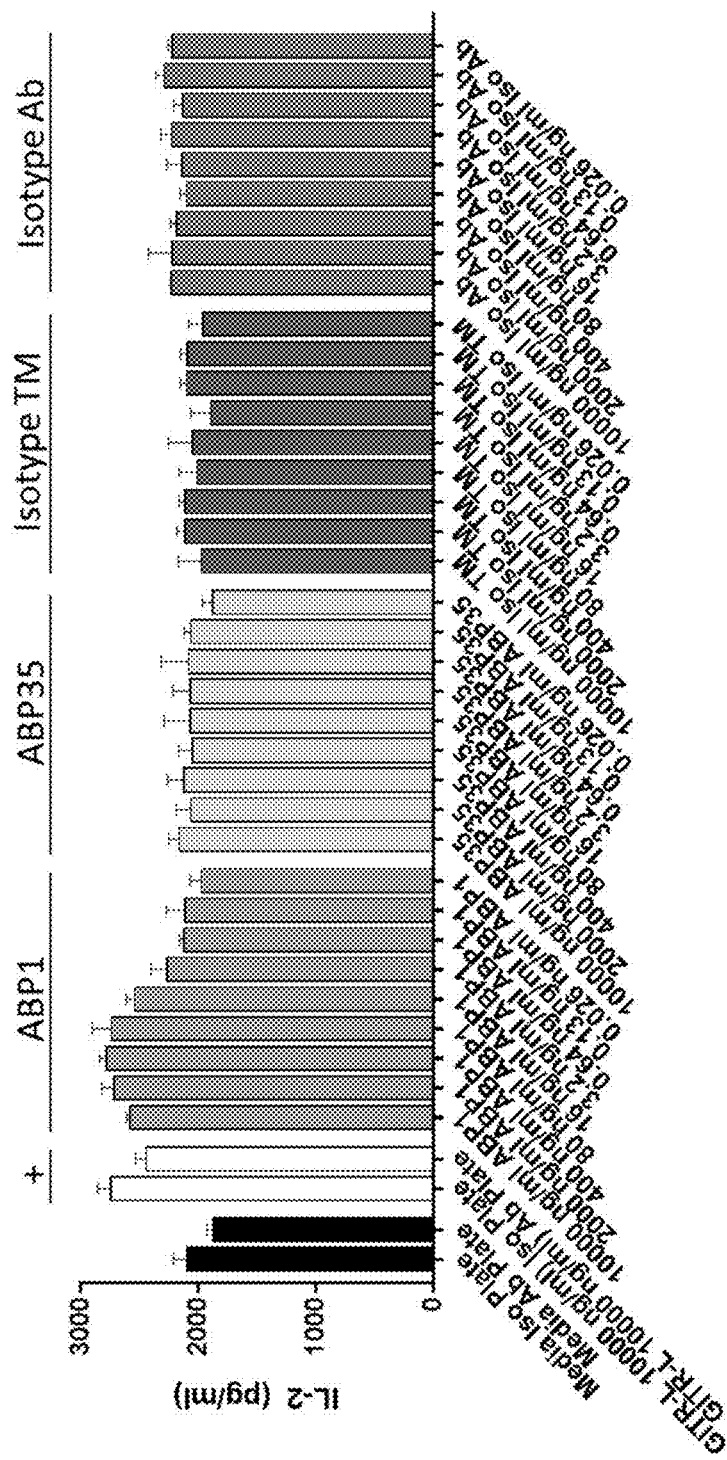
Figure 14A (Donor 1)

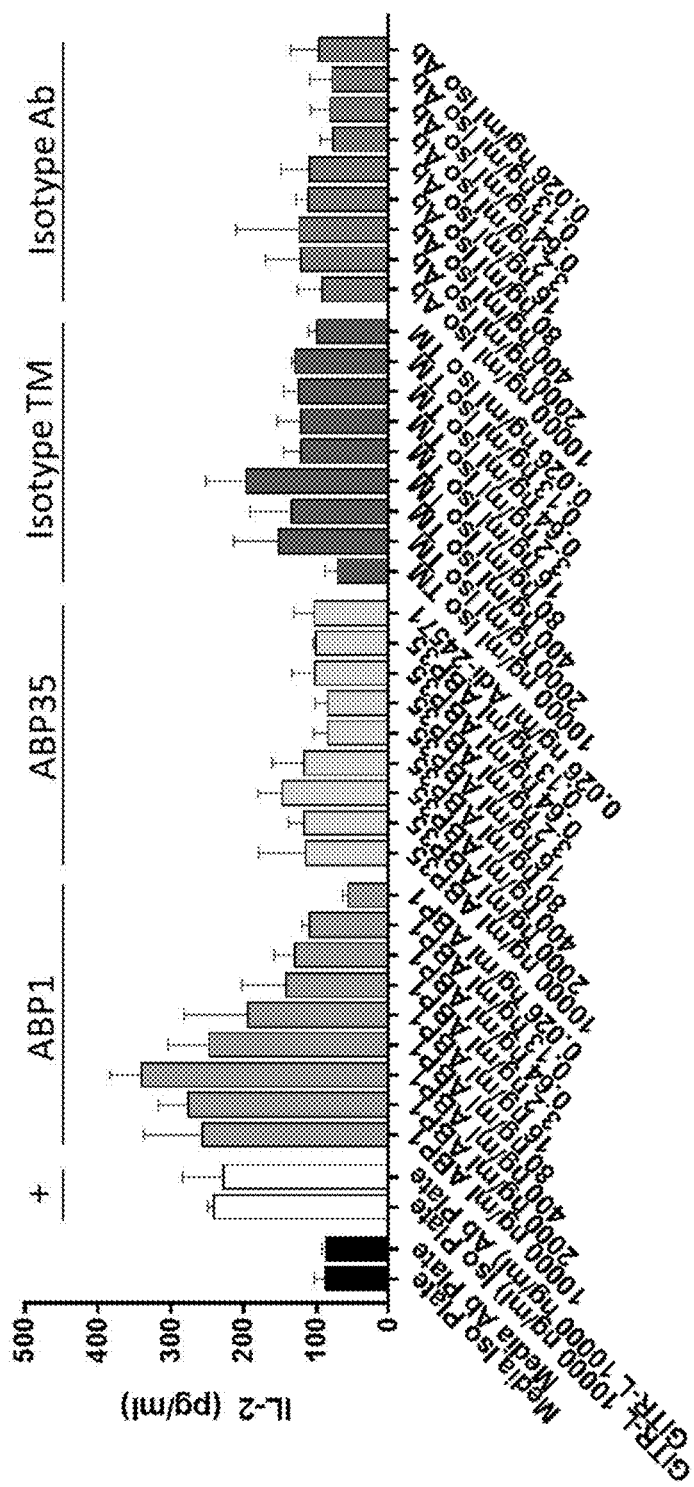
Figure 14B (Donor 2)

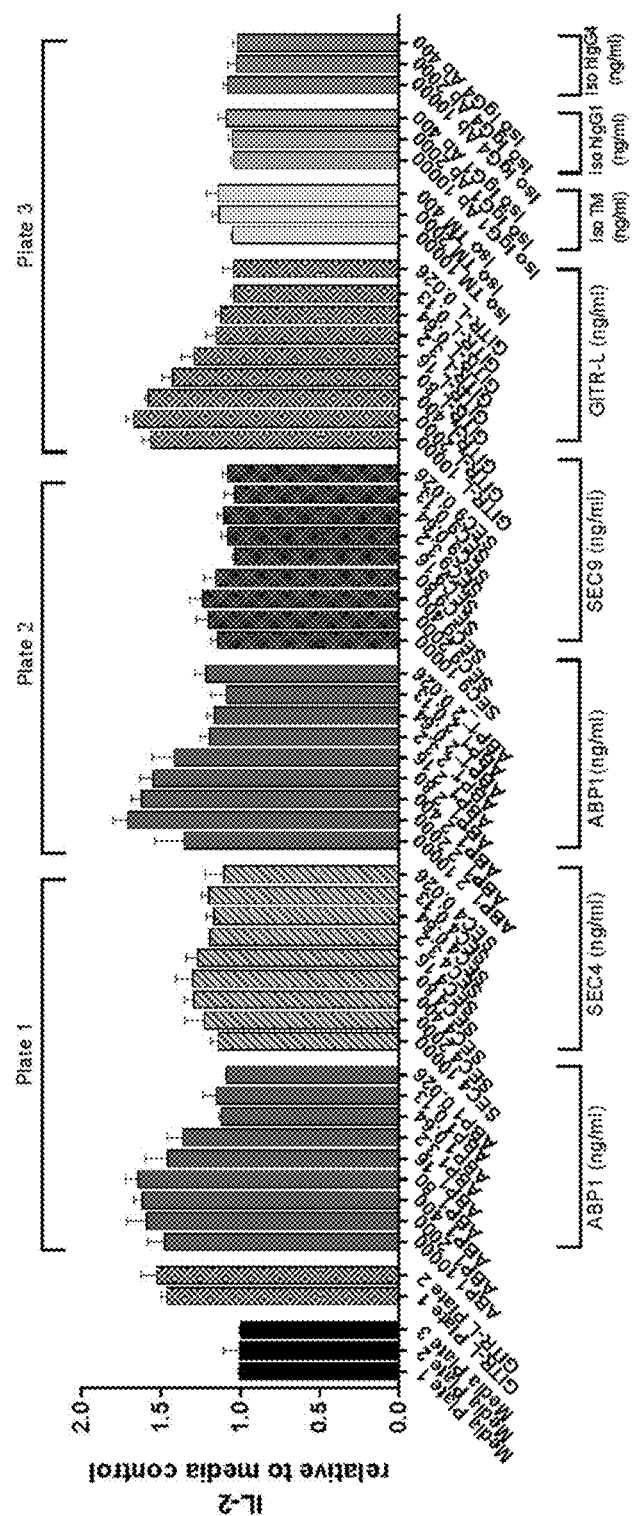
Figure 15A (Donor 1)

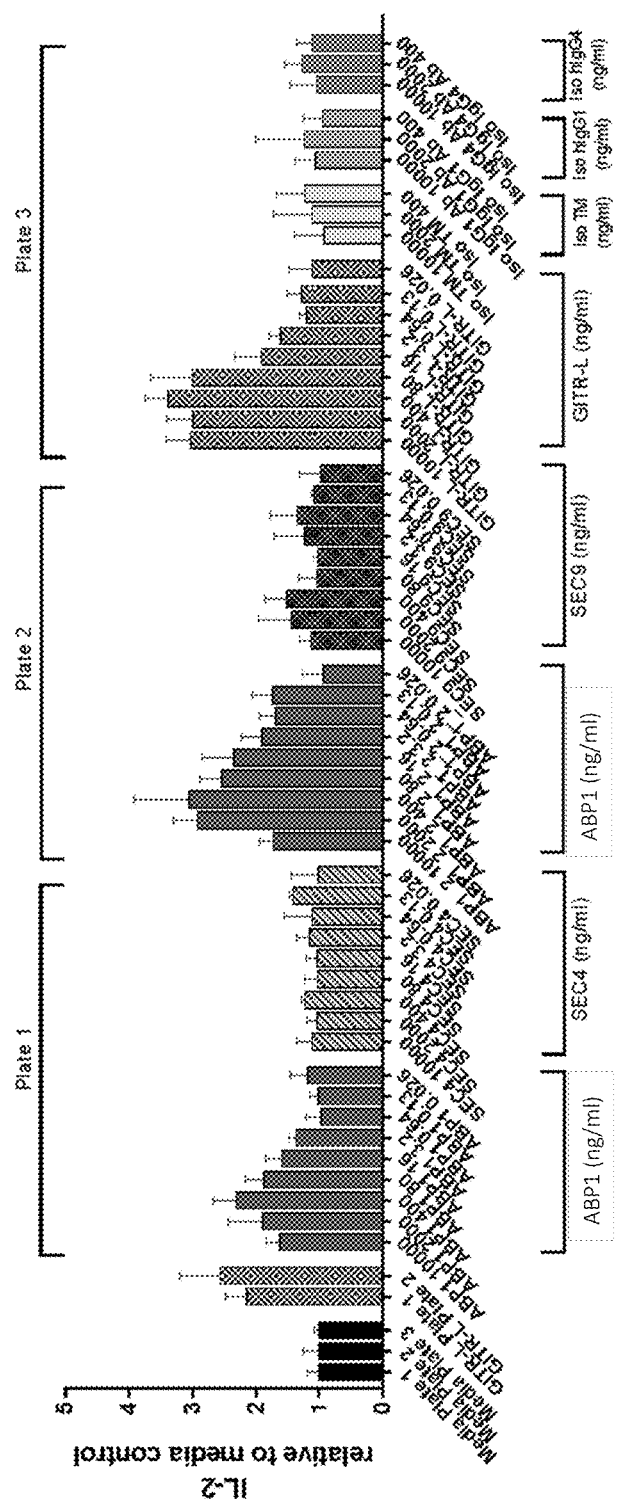
Figure 15B (Donor 2)

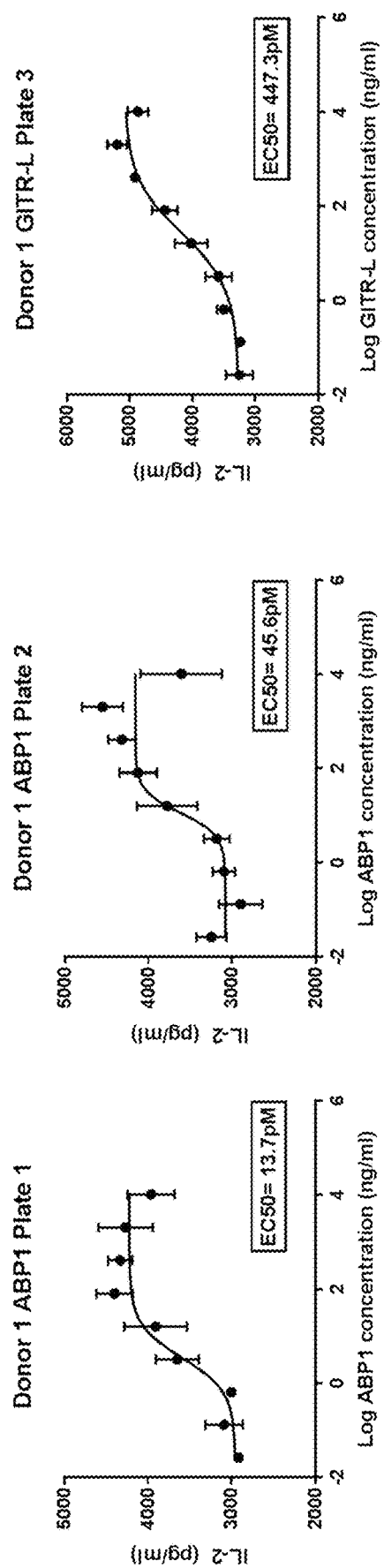
Figure 15C (Donor 1)

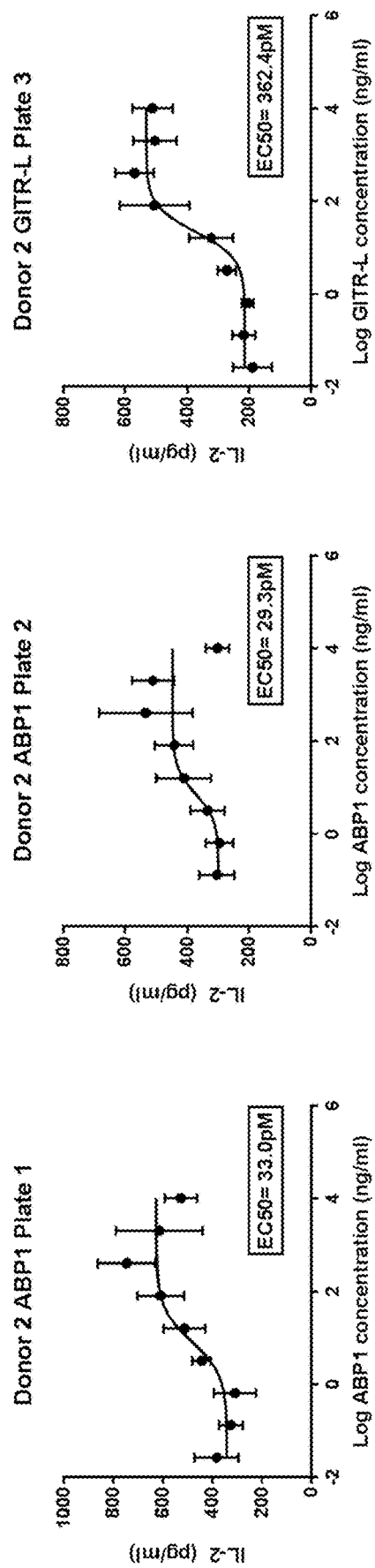
Figure 15D (Donor 2)

US 10,988,545 B2

ANTI-GITR ANTIGEN-BINDING PROTEINS AND METHODS OF USE THEREOF

SEQUENCE LISTING

The instant application contains a Sequence Listing which has been filed electronically in ASCII format and is hereby incorporated by reference in its entirety. Said ASCII copy, created on Feb. 15, 2018, is named 39500US_CRF_sequencelisting.txt and is 704,144 bytes in size.

FIELD

Provided herein are antigen-binding proteins (ABPs) with binding specificity for glucocorticoid-induced tumor necrosis factor receptor-related protein (GITR) and compositions comprising such ABPs, including pharmaceutical compositions, diagnostic compositions, and kits. Also provided are methods of making GITR ABPs, and methods of using GITR ABPs, for example, for therapeutic purposes, diagnostic purposes, and research purposes.

BACKGROUND

GITR is a member of the tumor necrosis factor receptor (TNFR) superfamily. GITR is expressed in many cells of the innate and adaptive immune system, and membrane surface expression is increased in activated T cells. See Hanabuchib et al., *Blood*, 2006, 107:3617-3623; and Nocentini et al., *Eur. J. Immunol.*, 2005, 35:1016-1022; each of which is incorporated by reference in its entirety. GITR is activated by GITR ligand (GITRL).

Agonism of GITR has a co-stimulatory effect on effector T cells. See Schaer et al., *Curr. Opin. Immunol.*, 2012, 24:217-224, incorporated by reference in its entirety. GITR agonists have been proposed as therapeutic agents for cancer therapy. See Schaer et al., supra; Melero et al., *Clin Cancer Res.*, 2013, 19:1044-1053; Cohen et al., *J. Clin. Oncol.*, 2007, 25:3058; Cohen et al., *PLoS One*, 2010, 5:e10436; Nocentini et al., *Br. J. Pharmacol.*, 2012, 165:2089-2099; and U.S. Pat. Pub. No. 2007/0098719; each of which is incorporated by reference in its entirety.

Although antibody agonists of GITR have shown promise in mouse models, it has been difficult to obtain agonizing antibodies to human GITR. Nocentini et al. (*Br. J. Pharmacol.*, 2012, 165:2089-2099) have noted that "[a]nti-GITR mAbs have much weaker triggering potential in humans than in mice." They speculate that this may be a result of the fact that human GITR must be multimerized into stable trimers or superclusters (e.g., tetramers of trimers) in order to be robustly activated.

Thus, there is a need for ABPs that can agonize human GITR more potently than known antibodies. Provided herein are ABPs that fulfill this need.

SUMMARY

Provided herein are ABPs that specifically bind GITR and methods of using such ABPs.

In one aspect is provided an isolated multivalent antigen binding protein (ABP) that specifically binds human GITR (hGITR; SEQ ID NO: 1), comprising the following six CDR sequences: (a) a CDR-H3 having the sequence $X_1X_2X_3X_4X_5$RGYGDYGGHHAFDI, wherein $X_1$ is A or V, $X_2$ is H, D, L, or R, $X_3$ is E or D, $X_4$ is R, N, S, or A, and $X_5$ is V, D or G (SEQ ID NO:141); (b) a CDR-H2 having the sequence $X_1IX_2X_3SGX_4$TYYNPSLKS, wherein $X_1$ is G, L, or S, $X_2$ is Y, A, or V, $X_3$ is E, Y or H, and $X_4$ is S or K (SEQ ID NO:142); (c) a CDR-H1 having the sequence $X_1$SISSX2$X_3X_4X_5$WX$_6$, wherein $X_1$ is Y or G, $X_2$ is G, S, or E, $X_3$ is L, G, S, Y, or A, $X_4$ is G, A, Y, or M, $X_5$ is V, A, or is absent, and X6 is S or G (SEQ ID NO:143); (d) a CDR-L3 having the sequence QQEYX$_1$TPPX$_2$, wherein $X_1$ is A or N and $X_2$ is T or S (SEQ ID NO:144); (e) a CDR-L2 having the sequence $X_1$AX$_2$SLX$_3X_4$, wherein $X_1$ is A or S, $X_2$ is D or S, $X_3$ is Q, D, K, or E, and $X_4$ is S or Y (SEQ ID NO:145); and (f) a CDR-L1 having the sequence $X_1$AS X$_2$SI X$_3$X4YLN, wherein $X_1$ is G or R, $X_2$ is Q or K, X3 is S, D, or N, and $X_4$ is S or T (SEQ ID NO:146).

In one embodiment, the ABP of (a) comprises a V$_H$ sequence of SEQ ID NO:9 and a V$_L$ sequence of SEQ ID NO:10; in another embodiment, the ABP of (b) comprises a V$_H$ sequence of SEQ ID NO:19 and a V$_L$ sequence of SEQ ID NO:20; in another embodiment, the ABP of (c) comprises a V$_H$ sequence of SEQ ID NO:26 and a V$_L$ sequence of SEQ ID NO:27; in another embodiment, the ABP of (d) comprises a V$_H$ sequence of SEQ ID NO:26 or SEQ ID NO:34 and a V$_L$ sequence of SEQ ID NO:35; in another embodiment, the ABP of (e) comprises a V$_H$ sequence of SEQ ID NO:26 and a V$_L$ sequence of SEQ ID NO:40; in another embodiment, the ABP of (f) comprises a V$_H$ sequence of SEQ ID NO:44 and a V$_L$ sequence of SEQ ID NO:45; in another embodiment, the ABP of (g) comprises a V$_H$ sequence of SEQ ID NO:44 and a V$_L$ sequence of SEQ ID NO:53; in another embodiment, the ABP of (h) comprises a V$_H$ sequence of SEQ ID NO:58 and a V$_L$ sequence of SEQ ID NO:10; in another embodiment, the ABP of (i) comprises a V$_H$ sequence of SEQ ID NO:104 and a V$_L$ sequence of SEQ ID NO:10; and in another embodiment, the ABP of (j) comprises a V$_H$ sequence of SEQ ID NO:105 and a V$_L$ sequence of SEQ ID NO:10.

In one embodiment, the ABP of (b) comprises a heavy chain of SEQ ID NO:7 and a light chain of SEQ ID NO:8; In another embodiment, the ABP of (b) comprises a heavy chain of SEQ ID NO:17 and a light chain of SEQ ID NO:18. In another embodiment, the ABP of (c) comprises a heavy chain of SEQ ID NO:24 and a light chain of SEQ ID NO:25. In another embodiment, the ABP of (d) comprises (i) a heavy chain of SEQ ID NO:32 and a light chain of SEQ ID NO:33, or (ii) a heavy chain of SEQ ID NO:37 and a light chain of SEQ ID NO:33. In another embodiment, the ABP of (e) comprises (i) a heavy chain of SEQ ID NO:38 and a light chain of SEQ ID NO:39. In another embodiment, the ABP of (f) comprises a heavy chain of SEQ ID NO:42 and a light chain of SEQ ID NO:43; in another embodiment, the ABP of (g) comprises (i) a heavy chain of SEQ ID NO:51 and a light chain of SEQ ID NO:52; In another embodiment, the ABP of (h) comprises (i) a heavy chain of SEQ ID NO:57 and a light chain of SEQ ID NO:8; In another embodiment, the ABP of (i) comprises (i) a heavy chain of SEQ ID NO:114 and a light chain of SEQ ID NO:8, or (ii) a heavy chain of SEQ ID NO:120 and a light chain of SEQ ID NO:8; or (iii) a heavy chain of SEQ ID NO:122 and a light chain of SEQ ID NO:8; or in another embodiment, the ABP of (j) comprises (i) a heavy chain of SEQ ID NO:115 and a light chain of SEQ ID NO:8, or (ii) a heavy chain of SEQ ID NO:121 and a light chain of SEQ ID NO:8; or (iii) a heavy chain of SEQ ID NO:123 and a light chain of SEQ ID NO:8.

In another embodiment, the ABP comprises a heavy chain of SEQ ID NO:7 and a light chain of SEQ ID NO:8; or a heavy chain of SEQ ID NO:221 and a light chain of SEQ ID NO:18; or a heavy chain of SEQ ID NO:24 and a light chain of SEQ ID NO:25; a heavy chain of SEQ ID NO:32 and a light chain of SEQ ID NO:33, or (ii) a heavy chain of SEQ ID NO:37 and a light chain of SEQ ID NO:33; a heavy chain of SEQ ID NO:38 and a light chain of SEQ ID NO:39; a heavy chain of SEQ ID NO:42 and a light chain of SEQ ID NO:43; a heavy chain of SEQ ID NO:51 and a light chain of SEQ ID NO:52; a heavy chain of SEQ ID NO:57 and a light chain of SEQ ID NO:8; a heavy chain of SEQ ID NO:114 and a light chain of SEQ ID NO:8, or (ii) a heavy chain of SEQ ID NO:120 and a light chain of SEQ ID NO:8; or (iii) a heavy chain of SEQ ID NO:122 and a light chain of SEQ ID NO:8; or a heavy chain of SEQ ID NO:115 and a light chain of SEQ ID NO:8, or (ii) a heavy chain of SEQ ID NO:121 and a light chain of SEQ ID NO:8; or (iii) a heavy chain of SEQ ID NO:123 and a light chain of SEQ ID NO:8.

In another aspect is provided an isolated multivalent antigen binding protein (ABP) that specifically binds human GITR (hGITR; SEQ ID NO: 1), comprising the following six CDR sequences: (a) a CDR-H3 having the sequence set forth in SEQ ID NO:66; (b) a CDR-H2 having the sequence set forth in SEQ ID NO:65; (c) a CDR-H1 having the sequence set forth in SEQ ID NO:64; (d) a CDR-L3 having the sequence set forth in SEQ ID NO:69; (e) a CDR-L2 having the sequence set forth in SEQ ID NO:68; and (f) a CDR-L1 having the sequence set forth in SEQ ID NO:67.

In one embodiment, the ABP comprises a $V_H$ sequence of SEQ ID NO:62 and a $V_L$ sequence of SEQ ID NO:63; a $V_H$ sequence of SEQ ID NO:70 and a $V_L$ sequence of SEQ ID NO:63; or a $V_H$ sequence of SEQ ID NO:97 and a $V_L$ sequence of SEQ ID NO:63.

In another embodiment, the ABP comprises (i) a heavy chain of SEQ ID NO:171 and a light chain of SEQ ID NO:172; a heavy chain of SEQ ID NO:173 and a light chain of SEQ ID NO:174; a heavy chain sequence of SEQ ID NO:106 and a light chain sequence of SEQ ID NO:107; or (ii) a heavy chain sequence of SEQ ID NO:116 and a light chain sequence of SEQ ID NO:107.

In another aspect is provided an isolated multivalent antigen binding protein (ABP) that specifically binds human GITR (hGITR; SEQ ID NO: 1), comprising the following six CDR sequences: (a) a CDR-H3 having the sequence set forth in SEQ ID NO:75; (b) a CDR-H2 having the sequence set forth in SEQ ID NO:74; (c) a CDR-H1 having the sequence set forth in SEQ ID NO:73; (d) a CDR-L3 having the sequence set forth in SEQ ID NO:78; (e) a CDR-L2 having the sequence set forth in SEQ ID NO:77; and (f) a CDR-L1 having the sequence set forth in SEQ ID NO:75.

In one embodiment, the ABP comprises a $V_H$ sequence of SEQ ID NO:71 and a $V_L$ sequence of SEQ ID NO:72; or a $V_H$ sequence of SEQ ID NO:98 and a $V_L$ sequence of SEQ ID NO:72.

In another embodiment, the ABP comprises a heavy chain of SEQ ID NO:173 and a light chain of SEQ ID NO:109; or the ABP comprises (i) a heavy chain of SEQ ID NO:108 and a light chain of SEQ ID NO:109; or (ii) a heavy chain of SEQ ID NO:117 and a light chain of SEQ ID NO:109.

In another aspect is provided an isolated multivalent antigen binding protein (ABP) that specifically binds human GITR (hGITR; SEQ ID NO: 1), comprising the following six CDR sequences: (a) a CDR-H3 having the sequence set forth in SEQ ID NO:83; (b) a CDR-H2 having the sequence set forth in (i) SEQ ID NO:82, or (ii) SEQ ID NO:100; (c) a CDR-H1 having the sequence set forth in SEQ ID NO:81; (d) a CDR-L3 having the sequence set forth in SEQ ID NO:86; (e) a CDR-L2 having the sequence set forth in SEQ ID NO:85; and (f) a CDR-L1 having the sequence set forth in SEQ ID NO:84.

In one embodiment, the ABP comprises the CDR-H2 sequence of (b)(i) of the above paragraph and a $V_H$ sequence of SEQ ID NO:79 and a $V_L$ sequence of SEQ ID NO:80. In another embodiment, the ABP comprises the CDR-H2 sequence of (b)(i) of the above paragraph and a $V_H$ sequence of SEQ ID NO:87 and a $V_L$ sequence of SEQ ID NO:80. In another embodiment, the ABP comprises the CDR-H2 sequence of (b)(i) of the above paragraph and a $V_H$ sequence of SEQ ID NO:88 and a $V_L$ sequence of SEQ ID NO:80. In another embodiment, the ABP comprises the CDR-H2 sequence of (b)(ii) of the above paragraph and a $V_H$ sequence of SEQ ID NO:99 and a $V_L$ sequence of SEQ ID NO:80.

In one embodiment, the ABP comprises a heavy chain of SEQ ID NO:174 and a light chain of SEQ ID NO:111; In another embodiment, the ABP comprises a heavy chain of SEQ ID NO:175 and a light chain of SEQ ID NO:111; in another embodiment, the ABP comprises a heavy chain of SEQ ID NO:176 and a light chain of SEQ ID NO:111; In another embodiment, the ABP comprises a heavy chain of SEQ ID NO:110 and a light chain of SEQ ID NO:111; or (ii) a heavy chain of SEQ ID NO:118 and a light chain of SEQ ID NO:111.

In another aspect is provided an isolated multivalent antigen binding protein (ABP) that specifically binds human GITR (hGITR; SEQ ID NO:1), comprising the following six CDR sequences: (a) a CDR-H3 having the sequence set forth in SEQ ID NO:93; (b) a CDR-H2 having the sequence GIIPIFGEAQYAQX$_1$FX$_2$G, wherein X$_1$ is K or R, and X$_2$ is Q or R (SEQ ID NO:215); (c) a CDR-H1 having the sequence set forth in SEQ ID NO:91; (d) a CDR-L3 having the sequence set forth in SEQ ID NO:94; (d) a CDR-L2 having the sequence set forth in SEQ ID NO:85; and (e) a CDR-L1 having the sequence set forth in SEQ ID NO:84.

In one embodiment, the ABP comprises: a CDR-H2 of SEQ ID NO:92; a CDR-H2 of SEQ ID NO:96; or a CDR-H2 of SEQ ID NO:102.

In another embodiment, the ABP comprises a $V_H$ sequence of SEQ ID NO:89 and a $V_L$ sequence of SEQ ID NO:90. In another embodiment, the ABP comprises a $V_H$ sequence of SEQ ID NO:95 and a $V_L$ sequence of SEQ ID NO:90. In another embodiment, the ABP comprises a $V_H$ sequence of SEQ ID NO:101 and a $V_L$ sequence of SEQ ID NO:90.

In another embodiment, the ABP comprises a heavy chain of SEQ ID NO:177 and a light chain of SEQ ID NO:113. In another embodiment, the ABP comprises a heavy chain of SEQ ID NO:178 and a light chain of SEQ ID NO:113. In another embodiment, the ABP comprises a heavy chain of SEQ ID NO:112 and a light chain of SEQ ID NO:113; or (ii) a heavy chain of SEQ ID NO:119 and a light chain of SEQ ID NO:113.

In another aspect is provided an isolated multivalent antigen binding protein (ABP) that specifically binds human GITR (hGITR; SEQ ID NO: 1), comprising the following six CDR sequences: (a) a CDR-H3 having the sequence set forth in SEQ ID NO:134; (b) a CDR-H2 having the sequence set forth in SEQ ID NO:133; a CDR-H1 having the sequence set forth in SEQ ID NO:132; (c) a CDR-L3 having the sequence set forth in SEQ ID NO:135; (d) a CDR-L2 having the sequence set forth in SEQ ID NO:68; and (e) a CDR-L1 having the sequence set forth in SEQ ID NO:67.

In one embodiment, the ABP comprises (i) a $V_H$ sequence of SEQ ID NO:126 and a $V_L$ sequence of SEQ ID NO:128; or (ii) a $V_H$ sequence of SEQ ID NO:127 and a $V_L$ sequence of SEQ ID NO:128.

In one embodiment, the ABP comprises (i) a heavy chain of SEQ ID NO:124 and a light chain of SEQ ID NO:125; or (ii) a heavy chain of SEQ ID NO:136 and a light chain of SEQ ID NO:125.

In another aspect is provided an isolated multivalent antigen binding protein (ABP) that specifically binds human GITR (hGITR; SEQ ID NO: 1), comprising: (a) a CDR-H3 having at least about 60%, at least about 70%, at least about 80%, at least about 90%, or at least about 95% identity to a CDR-H3 of a $V_H$ region selected from SEQ ID NOs: 9, 19, 26, 34, 44, 58, 62, 70, 71, 79, 87, 88, 89, 95, 97, 98, 99, 101, 104, 105, 126, and 127; (b) a CDR-H2 having at least about 60%, at least about 70%, at least about 80%, at least about 90%, or at least about 95% identity to a CDR-H2 of a $V_H$ region selected from SEQ ID NOs: 9, 19, 26, 34, 44, 58, 62, 70, 71, 79, 87, 88, 89, 95, 97, 98, 99, 101, 104, 105, 126, and 127; (c) a CDR-H1 having at least about 60%, at least about 70%, at least about 80%, at least about 90%, or at least about 95% identity to a CDR-H1 of a $V_H$ region selected from SEQ ID NOs: 9, 19, 26, 34, 44, 58, 62, 70, 71, 79, 87, 88, 89, 95, 97, 98, 99, 101, 104, 105, 126, and 127; (d) a CDR-L3 having at least about 60%, at least about 70%, at least about 80%, at least about 90%, or at least about 95% identity to a CDR-L3 of a $V_L$ region selected from SEQ ID NOs: 10, 20, 27, 35, 40, 45, 53, 63, 72, 80, 90, and 128; (e) a CDR-L2 having at least about 60%, at least about 70%, at least about 80%, at least about 90%, or at least about 95% identity to a CDR-L2 of a $V_L$ region selected from SEQ ID NOs: 10, 20, 27, 35, 40, 45, 53, 63, 72, 80, 90, and 128; and (f) a CDR-L1 having at least about 60%, at least about 70%, at least about 80%, at least about 90%, or at least about 95% identity to a CDR-L1 of a $V_L$ region selected from SEQ ID NOs: 10, 20, 27, 35, 40, 45, 53, 63, 72, 80, 90, and 128.

In one embodiment, the CDR-H3, CDR-H2, CDR-H1, CDR-L3, CDR-L2, and CDR-L1 are each identified according to a numbering scheme selected from the Kabat numbering scheme, the Chothia numbering scheme, or the IMGT numbering scheme. In another embodiment, the CDR-H1 is identified as defined by both the Chothia and Kabat numbering schemes, inclusive of the boundaries of both numbering schemes.

In one embodiment, the CDR-H3 comprises a CDR-H3 selected from SEQ ID NOs: 13, 23, 30, 48, 61, 66, 75, 83, 93, 103, 131, or a variant thereof having 1, 2, or 3 amino acid substitutions. In another embodiment, the CDR-H2 comprises a CDR-H3 selected from SEQ ID NOs: 12, 22, 29, 47, 60, 65, 74, 82, 92, 96, 100, 102, 130, and 133, or a variant thereof having 1, 2, or 3 amino acid substitutions. In another embodiment, the CDR-H1 comprises a CDR-H1 selected from SEQ ID NOs: 11, 21, 28, 46, 59, 64, 73, 81, 91, 129, 132, or a variant thereof having 1 or 2 amino acid substitutions. In another embodiment, the CDR-L3 comprises a CDR-L3 selected from SEQ ID NOs: 16, 17, 56, 69, 78, 86, 94, 135, or a variant thereof having 1 or 2 amino acid substitutions. In another embodiment, the CDR-L2 comprises a CDR-L2 selected from SEQ ID NOs: 15, 31, 41, 50, 55, 68, 77, and 85, or a variant thereof having 1 amino acid substitution. In another embodiment, the CDR-L1 comprises a CDR-L1 selected from SEQ ID NOs: 14, 36, 49, 54, 67, 76, and 84, or a variant thereof having 1 or 2 amino acid substitutions. In one embodiment, the amino acid substitutions are conservative amino acid substitutions.

In an embodiment of any of the above aspects, the ABP: (a) competes for binding to GITR with an antibody selected from ABP1, ABP2, ABP3, ABP4, ABP5, ABP6, ABP7, ABP8, ABP9, ABP10, ABP11, ABP12, ABP13, ABP14, ABP15, ABP16, ABP17, ABP18, ABP19, ABP20, ABP21, ABP22, ABP23, ABP24, ABP25, ABP26, ABP27, ABP28, ABP29, ABP30, ABP31, ABP32, ABP33, and ABP34, each as provided in Appendix A of this disclosure; or (b) has at least three antigen-binding domains that specifically bind an epitope on GITR; or (c) has at least three antigen-binding domains that specifically bind a single epitope on GITR; or (d) has at least four antigen-binding domains that specifically bind an epitope on GITR; or (e) has at least four antigen-binding domains that specifically bind a single epitope on GITR; or (f) agonizes GITR expressed on the surface of a target cell; or (g) enhances the binding of GITRL to GITR; or (h) co-stimulates an effector T cell in combination with antigen presentation from an antigen-presenting cell; or (i) inhibits the suppression of an effector T cell by a regulatory T cell; or (j) reduces the number of regulatory T cells in a tissue or in systemic circulation; (k) is capable of binding to one or more of GITR (SEQ ID NO:1) residues from the group consisting of R56, C58, R59, D60, Y61, P62, E64, E65, C66, and C67; or (l) is capable of any combination of (a)-(k).

In an embodiment of any of the above aspects, the GITR is selected from hGITR (SEQ ID NO: 1), hGITR-T43R (SEQ ID NO: 2), cGITR (SEQ ID NO: 3), mGITR (SEQ ID NO: 4), and combinations thereof. In another embodiment, the ABP (a) specifically binds cynomolgus monkey GITR (cGITR; SEQ ID NO: 3); (b) binds murine GITR (mGITR; SEQ ID NO: 4) with an affinity lower (as indicated by higher KD) than the affinity of the ABP for hGITR, or does not bind mGITR; or (c) is capable of any combination of (a)-(b). In another embodiment, the ABP: (a) specifically binds cGITR (SEQ ID NO: 3); (b) binds mGITR (SEQ ID NO: 4) with an affinity lower (as indicated by higher KD) than the affinity of the ABP for hGITR and cGITR; and (c) enhances binding of GITRL to GITR.

In another aspect is provided an ABP that competes for binding to GITR with an ABP of any one of claims 1-26, wherein the ABP: (a) specifically binds cGITR (SEQ ID NO: 3); (b) binds mGITR (SEQ ID NO: 4) with an affinity lower (as indicated by higher KD) than the affinity of the ABP for hGITR and cGITR; and (c) enhances binding of GITRL to GITR. In one embodiment, the ABP comprises an antibody. In another embodiment, the antibody is a monoclonal antibody. In another embodiment, the antibody is selected from a human antibody, a humanized antibody or a chimeric antibody. In another embodiment, the ABP is multivalent. In another embodiment, the ABP comprises an antibody fragment.

In another embodiment, the ABP comprises an alternative scaffold. In another embodiment, the ABP comprises an immunoglobulin constant region. In another embodiment, the ABP comprises heavy chain constant region of a class selected from IgA, IgD, IgE, IgG, or IgM. In another embodiment, the ABP comprises a heavy chain constant region of the class IgG and a subclass selected from IgG4, IgG1, IgG2, or IgG3.

In an embodiment of any of the above aspects, at least one Fab is fused to a C-terminus of an Fc domain of an IgG. In another embodiment, the ABP further comprises at least one linker. In another embodiment, the IgG is an IgG4. In another embodiment, the IgG is an IgG1. In another embodiment, at least one Fab is fused to an N-terminus of an Fc domain of an IgG. In one embodiment, the at least one Fab is at least two Fabs. In another embodiment, the at least one Fab is at least three Fabs. In another embodiment, the at least one Fab is at least four Fabs. In another embodiment, two Fabs are independently fused to an N-terminus of the IgG. In another embodiment, two Fabs are independently fused to a C-terminus of the IgG. In another embodiment, a Fab is attached to each N-terminus of the IgG, a linker is attached to each said Fab, and a Fab is attached to each linker. In another embodiment, a Fab is attached to each C-terminus of the IgG, a linker is attached to each said Fab, and a Fab is attached to each linker. In another embodiment, wherein each linker comprises SEQ ID NO:5. In another embodiment, each linker comprises SEQ ID NO:6.

In an embodiment of any of the above aspects, the ABP comprises a common light chain antibody, an antibody with a knobs-into-holes modification, an scFv attached to an IgG, a Fab attached to an IgG, a diabody, a tetravalent bispecific antibody, a DVD-Ig™, a DART™, a DuoBody®, a CovX-Body, an Fcab antibody, a TandAb®, a tandem Fab, a Zybody™, or combinations thereof. In one embodiment, the ABP binds more than one GITR molecule. In another embodiment, the ABP is independent of GITRL binding. In another embodiment, the ABP enhances binding of GITRL to GITR by at least about 10%, at least about 20%, at least about 30%, at least about 40%, at least about 50%, at least about 60%, at least about 70%, at least about 80%, or at least about 90%. In another embodiment, the ABP enhances binding of GITRL to GITR by at least about 50%. In another embodiment, the target cell is selected from an effector T cell, a regulatory T cell, a natural killer (NK) cell, a natural killer T (NKT) cell, a dendritic cell, and a B cell. In another embodiment, the target cell is an effector T cell selected from a helper (CD4+) T cell, a cytotoxic (CD8+) T cell, and combinations thereof. In another embodiment, the target cell is a regulatory T cell selected from a CD4+CD25+Foxp3+ regulatory T cell, a CD8+CD25+ regulatory T cell, and combinations thereof. In another embodiment, the tissue is a tumor.

In an embodiment of any of the above aspects, the KD of the first antigen-binding domain for hGITR (SEQ ID NO: 1) or hGITR-T43R (SEQ ID NO: 2) is less than about 20 nM. In one embodiment, the KD of the first antigen-binding domain for cGITR (SEQ ID NO: 3) is less than about 200 nM. In another embodiment, the KD of the second antigen-binding domain for hGITR (SEQ ID NO: 1) or hGITR-T43R (SEQ ID NO: 2) is less than about 100 nM. In another embodiment, the KD of the second antigen-binding domain for cGITR (SEQ ID NO: 3) is less than about 1 μM. In another embodiment, the ABP comprises an Fc domain with reduced effector function when compared to an IgG1 Fc domain. In another embodiment, the ABP comprises an aglycosylated Fc domain. In another embodiment, the ABP comprises an IgG1 Fc domain with an alanine at one or more of positions 234, 235, 265, and 297.

In an embodiment of any of the above aspects, the GITR is expressed on the surface of a target cell. In one embodiment, the ABP multimerizes GITR expressed on the surface of a target cell. In one embodiment, the ABP multimerizes 2, 3, 4, 5, 6, 7, 8, 9, 10, 11, or 12 GITR molecules.

In an embodiment of any of the above aspects, the ABP specifically binds an epitope of human GITR (hGITR; SEQ ID NO:1) and is capable of binding one or more residues from the group consisting of R56, C58, R59, D60, Y61, P62, E64, E65, C66, and C67.

In an embodiment of any of the above aspects, the ABP comprises an immunoglobulin comprising at least two different (i.e., have different sequences and/or bind to different residues) heavy chain variable regions each paired with a common light chain variable region. In another embodiment, the common light chain variable region forms a distinct antigen-binding domain with each of the two different heavy chain variable regions. In another embodiment, the ABP comprises a first $V_H$ variable domain having SEQ ID NO:189, a second $V_H$ variable domain having SEQ ID NO:215, and a common variable light chain having SEQ ID NO:190. In another embodiment, the ABP comprises a first $V_H$ variable domain having SEQ ID NO:199, a second $V_H$ variable domain having SEQ ID NO:216, and a common variable light chain having SEQ ID NO:200.

Provided in another aspect is a kit comprising an ABP of any of the above aspects or set forth in Appendix A, and instructions for use of the ABP. In one embodiment, the ABP is lyophilized. In another embodiment, the kit further comprises a fluid for reconstitution of the lyophilized ABP.

It is known that when an antibody is expressed in cells, the antibody is modified after translation. Examples of the posttranslational modification include cleavage of lysine at the C terminal of the heavy chain by a carboxypeptidase; modification of glutamine or glutamic acid at the N terminal of the heavy chain and the light chain to pyroglutamic acid by pyroglutamylation; glycosylation; oxidation; deamidation; and glycation, and it is known that such posttranslational modifications occur in various antibodies (See journal of Pharmaceutical Sciences, 2008, Vol. 97, p. 2426-2447, incorporated by reference in its entirety). In some embodiments, an ABP of the invention is an antibody or antigen-binding fragment thereof which has undergone posttranslational modification. Examples of an antibody or antigen binding fragment thereof which have undergone posttranslational modification include an antibody or antigen-binding fragments thereof which have undergone pyroglutamylation at the N terminal of the heavy chain variable region and/or deletion of lysine at the C terminal of the heavy chain. It is known in the art that such posttranslational modification due to pyroglutamylation at the terminal and deletion of lysine at the C terminal does not have any influence on the activity of the antibody or fragment thereof (Analytical Biochemistry, 2006, Vol. 348, p. 24-39, incorporated by reference in its entirety).

In an embodiment of any of the above aspects, the ABP comprises a polypeptide sequence having a pyroglutamate (pE) residue at its N-terminus. In one embodiment, the ABP comprises a $V_H$ sequence in which an N-terminal Q is substituted with pE. In another embodiment, the ABP comprises a $V_L$ sequence in which an N-terminal E is substituted with pE. In another embodiment, the ABP comprises a heavy chain sequence in which an N-terminal Q is substituted with pE.

In an embodiment of any of the above aspects, the ABP comprises a light chain sequence in which an N-terminal E is substituted with pE. In another embodiment, the ABP is for use as a medicament. In another embodiment, the ABP is for use in the treatment of a cancer or viral infection.

In one embodiment, the ABP is for use in the treatment of a cancer, wherein the cancer is selected from a solid tumor and a hematological tumor.

In another aspect is provided an isolated polynucleotide encoding an ABP of any of the above aspects or set forth in Appendix A, a $V_H$ thereof, a $V_L$ thereof, a light chain thereof, a heavy chain thereof or an antigen-binding portion thereof.

In another aspect is provided a vector comprising the polynucleotide of the above aspect. In another aspect is provided a host cell comprising the polynucleotide or the vector of any of the above aspects. In one embodiment, the host cell is selected from a bacterial cell, a fungal cell, and a mammalian cell. In another embodiment, the host cell is selected from an *E. coli* cell, a *Saccharomyces cerevisiae* cell, and a CHO cell.

In another aspect is provided a cell-free expression reaction comprising the polynucleotide or vector of the above aspects.

In another aspect is provided a method of producing an ABP of any of the above aspects or set forth in Appendix A, comprising expressing the ABP in the host cell and isolating the expressed ABP.

In another aspect is provided a pharmaceutical composition comprising an ABP of any of the above aspects or set forth in Appendix A, and a pharmaceutically acceptable excipient. In one embodiment, the amount of the ABP in the pharmaceutical composition is sufficient to (a) reduce the suppression of effector T cells by regulatory T cells; (b) activate effector T cells; (c) reduce the number of regulatory T cells in a tissue or systemically; (d) induce or enhance proliferation of effector T cells; (e) inhibit the rate of tumor growth; (f) induce tumor regression; or (g) combinations thereof, in a subject. In one embodiment, the pharmaceutical composition is for use as a medicament, e.g., for use in the treatment of a cancer or a viral infection. In one embodiment, the pharmaceutical composition is for use in the treatment of a cancer, wherein the cancer is selected from a solid tumor and a hematological tumor.

In another embodiment, the amount of the ABP in the pharmaceutical composition is sufficient to (a) reduce the suppression of effector T cells by regulatory T cells; (b) activate effector T cells; (c) reduce the number of regulatory T cells in a tissue or systemically; (d) induce or enhance proliferation of effector T cells; (e) inhibit the rate of tumor growth; (f) induce tumor regression; or (g) combinations thereof, in a subject.

In another aspect is provided a method of treating or preventing a disease or condition in a subject in need thereof, comprising administering to the subject an effective amount of an ABP of any of the above aspects or set forth in Appendix A, or a pharmaceutical composition thereof.

In another aspect is provided a method of method of increasing activation of immune cells in a subject, comprising administering to the subject an effective amount of an ABP of any of the above aspects or set forth in Appendix A, or a pharmaceutical composition thereof. In one embodiment, disease or condition is a cancer.

In another embodiment, the method induces or enhances an immune response to a cancer-associated antigen. In another embodiment, the ABP is administered in an amount sufficient to (a) reduce the suppression of effector T cells by regulatory T cells; (b) activate effector T cells; (c) reduce the number of regulatory T cells in a tissue or systemically; (d) induce or enhance proliferation of effector T cells; (e) inhibit the rate of tumor growth; (f) induce tumor regression; or (g) combinations thereof. In another embodiment, the cancer is a solid cancer. In another embodiment, the cancer is a hematological cancer. In another embodiment, the method further comprises administering one or more additional therapeutic agents. In one embodiment, the additional therapeutic agent is selected from radiation, a cytotoxic agent, a chemotherapeutic agent, a cytostatic agent, an anti-hormonal agent, an EGFR inhibitor, an immunostimulatory agent, an anti-angiogenic agent, and combinations thereof. In one embodiment, the additional therapeutic agent is an immunostimulatory agent. In one embodiment, the immunostimulatory agent comprises an agent that blocks signaling of an inhibitory receptor expressed by an immune cell or a ligand thereof. In one embodiment, the inhibitory receptor expressed by an immune cell or ligand thereof is selected from CTLA-4, PD-1, PD-L1, NRP1, LAG-3, Tim3, TIGIT, neuritin, BTLA, KIR, and combinations thereof. In one embodiment, the immunostimulatory agent comprises an agonist to a stimulatory receptor expressed by an immune cell. In another embodiment, the stimulatory receptor expressed by an immune cell is selected from OX40, ICOS, CD27, CD28, 4-1BB, CD40, and combinations thereof. In another embodiment, the immunostimulatory agent comprises a cytokine. In another embodiment, the cytokine is selected from IL-2, IL-5, IL-7, IL-12, IL-15, IL-21, and combinations thereof. In another embodiment, the immunostimulatory agent comprises an oncolytic virus. In another embodiment, the oncolytic virus is selected from herpes simplex virus, vesicular stomatitis virus, adenovirus, Newcastle disease virus, vaccinia virus, a maraba virus, and combinations thereof. In another embodiment, the immunostimulatory agent comprises a T cell expressing a chimeric antigen receptor. In another embodiment, the immunostimulatory agent comprises a bi- or multi-specific T cell directed antibody. In another embodiment, the immunostimulatory agent comprises an anti-TGF-β antibody, a TGF-β trap, or a combination thereof. In another embodiment, the immunostimulatory agent comprises a vaccine to a cancer-associated antigen.

In another aspect is provided a method of modulating an immune response in a subject in need thereof, comprising administering to the subject an effective amount of an ABP of any of the above aspects or set forth in Appendix A, or a pharmaceutical composition thereof. In one embodiment, the method further comprises administering one or more additional therapeutic agents to the subject. In one embodiment, the additional therapeutic agent is an agonist to a stimulatory receptor of an immune cell, and the stimulatory receptor of an immune cell is selected from OX40, CD2, CD27, CDS, ICAM-1, LFA-1 (CD11a/CD18), ICOS (CD278), 4-1BB (CD137), CD28, CD30, CD40, BAFFR, HVEM, CD7, LIGHT, NKG2C, SLAMF7, NKp80, CD160, B7-H3, CD83 ligand, and combinations thereof. In one embodiment, the additional therapeutic agent is a cytokine selected from IL-2, IL-5, IL-7, IL-12, IL-15, IL-21, and combinations thereof. In one embodiment, the additional therapeutic agent is an oncolytic virus selected from herpes simplex virus, vesicular stomatitis virus, adenovirus, Newcastle disease virus, vaccinia virus, a maraba virus, and combinations thereof. In one embodiment, the additional therapeutic agent is formulated in the same pharmaceutical composition as the ABP. In one embodiment, the additional therapeutic agent is formulated in a different pharmaceutical composition from the ABP. In one embodiment, the additional therapeutic agent is administered prior to administering the ABP. In one embodiment, the additional therapeutic agent is administered after administering the ABP. In one embodiment, the additional therapeutic agent is administered contemporaneously with the ABP.

In another aspect is provided an isolated multivalent antigen binding protein (ABP) that specifically binds human GITR (hGITR; SEQ ID NO: 1), wherein the ABP competes for binding with one or more of ABP1, ABP2, ABP3, ABP4, ABP5, ABP6, ABP7, ABP8, ABP9, ABP10, ABP11, ABP12, ABP13, ABP14, ABP15, ABP16, ABP17, ABP18, ABP19, ABP20, ABP21, ABP22, ABP23, ABP24, ABP25, ABP26, ABP27, ABP28, ABP29, ABP30, ABP31, ABP32, ABP33, and ABP34, ABP50, ABP51, ABP52, ABP53, ABP54, ABP55, ABP56, ABP57, ABP62, ABP63, ABP64, ABP65, ABP66, ABP67, ABP68, ABP67, ABP68, ABP69, ABP70, ABP71, ABP72, ABP73, ABP74, ABP75, ABP76, ABP77, ABP78, ABP79, ABP80, ABP812, ABP82, ABP83, ABP84, ABP85, ABP86, ABP87, ABP88, ABP89, ABP90, ABP91, ABP92, ABP93, ABP94, ABP95, ABP96, ABP97, ABP98, ABP99, ABP100, ABP102, ABP103, ABP104, ABP105, ABP106, ABP107, ABP108, and ABP109, each as provided in Appendix A of this disclosure.

In another aspect is provided an anti-human GITR antibody or an antigen-binding fragment thereof comprising four heavy chain variable regions and four light chain variable regions, wherein the heavy chain variable region comprises a CDR-H3 consisting of SEQ ID NO:13, a CDR-H2 consisting of SEQ ID NO:12 and a CDR-H1 consisting of SEQ ID NO:11; and the light chain variable region comprises a CDR-L3 consisting of SEQ ID NO:16, a CDR-L2 consisting of SEQ ID NO:15, and a CDR-L1 consisting of SEQ ID NO:14; and the one heavy chain variable region and the one light chain variable region constitute one antigen-binding site, and the antibody or the antigen-binding fragment comprises four antigen-binding sites.

In one embodiment, the anti-human GITR antibody or the antigen-binding fragment thereof comprises four heavy chain variable regions and four light chain variable regions, in which the heavy chain variable region consists of SEQ ID NO: 9, the light chain variable region consists of SEQ ID NO: 10, and the one heavy chain variable region and the one light chain variable region constitute one antigen-binding site, and the antibody or the antigen-binding fragment comprises four antigen-binding sites.

In one embodiment, the anti-human GITR antibody or the antigen-binding fragment thereof comprises four heavy chain variable regions and four light chain variable regions, in which the heavy chain variable region consists of SEQ ID NO: 9, wherein Q at position 1 of the sequence is modified to pyroglutamate, the light chain variable region consists of SEQ ID NO: 10, and the one heavy chain variable region and the one light chain variable region constitute one antigen-binding site, and the antibody or the antigen-binding fragment comprises four antigen-binding sites.

In one embodiment, the anti-human GITR antibody comprises two heavy chains and four light chains, each heavy chain comprises two structures consisting of a heavy chain variable region and a CH1 region, a CH2 region, and a CH3 region, and the C terminus of one of the structures is linked to the N terminus of the other structure through a linker, and each light chain comprises a light chain variable region and a light chain constant region (left panel in FIG. 1B).

In one embodiment, the anti-human GITR antibody comprises two heavy chains and four light chains, the heavy chains each comprising a first heavy chain variable region and a first CH1 region, a linker, a second heavy chain variable region, a second CH1 region, a CH2 region, and a CH3 region, and each light chain comprises a light chain variable region and a light chain constant region (left panel in FIG. 1B).

In one embodiment, the anti-human GITR antibody comprises two heavy chains and four light chains; each heavy chain comprises two structures consisting of a heavy chain variable region comprising a CDR-H3 consisting of SEQ ID NO:13, a CDR-H2 consisting of SEQ ID NO:12 and a CDR-H1 consisting of SEQ ID NO:11 and a CH1 region, a CH2 region, and a CH3 region, and the carboxy terminus (C terminus) of one of the structures is linked to the amino terminus (N terminus) of the other structure through a linker; and each light chain comprises a light chain variable region comprising a CDR-L3 consisting of SEQ ID NO:16, a CDR-L2 consisting of SEQ ID NO:15, and a CDR-L1 consisting of SEQ ID NO:14.

In one embodiment, the anti-human GITR antibody comprises two heavy chains and four light chains; each heavy chain comprising a first heavy chain variable region and a second heavy chain variable region, each comprising a CDR-H3 consisting of SEQ ID NO:13, a CDR-H2 consisting of SEQ ID NO:12 and a CDR-H1 consisting of SEQ ID NO:11; a first CH1 region, a linker, a second CH1 region, a CH2 region, and a CH3 region; and each light chain comprises a light chain variable region comprising a CDR-L3 consisting of SEQ ID NO:16, a CDR-L2 consisting of SEQ ID NO:15, and a CDR-L1 consisting of SEQ ID NO:14.

In one embodiment, the anti-human GITR antibody comprising two heavy chains and four light chains, in which each heavy chain comprises two structures consisting of a heavy chain variable region of SEQ ID NO: 9 and a CH1 region, a CH2 region, and a CH3 region, and the C terminus of one of the structures is linked to the N terminus of the other structure through a linker, and each light chain comprises a light chain variable region of SEQ ID NO: 10, and a light chain constant region.

In one embodiment, the anti-human GITR antibody comprises two heavy chains and four light chains, each heavy chain comprising a first heavy chain variable region and a second heavy chain variable region, each as set forth as SEQ ID NO: 9; a first CH1 region, a linker, a second CH1 region, a CH2 region, and a CH3 region; and wherein each light chain comprises a light chain variable region of SEQ ID NO: 10, and a light chain constant region.

In one embodiment, the anti-human GITR antibody comprising two heavy chains and four light chains, in which each heavy chain comprises two structures consisting of a heavy chain variable region of SEQ ID NO: 9 and a CH1 region, a CH2 region, and a CH3 region, and the C terminus of one of the structures is linked to the N terminus of the other structure through a linker, wherein Q at position 1 of the sequence is modified to pyroglutamate, and each light chain comprises a light chain variable region of SEQ ID NO: 10, and a light chain constant region.

In one embodiment, the anti-human GITR antibody comprises two heavy chains and four light chains, each heavy chain comprising a first heavy chain variable region and a second heavy chain variable region, each as set forth as SEQ ID NO: 9; a first CH1 region, a linker, a second CH1 region, a CH2 region, and a CH3 region; wherein Q at position 1 of the sequence is modified to pyroglutamate, and each light chain comprises a light chain variable region of SEQ ID NO: 10, and a light chain constant region.

In one embodiment, the anti-human GITR antibody comprises two heavy chains, each having two variable regions, of SEQ ID NO: 7 and four light chains of SEQ ID NO: 8.

In one embodiment, the anti-human GITR antibody comprises two heavy chains, each having two variable regions, of SEQ ID NO: 7, wherein the Q at position 1 of the sequence is modified to pyroglutamate and four light chains of SEQ ID NO: 8.

In one embodiment, the anti-human GITR antibody comprises two heavy chains, each having two variable regions, consisting of the amino acid sequence ranging from Q at position 1 to G at position 686 of SEQ ID NO: 7, and four light chains of SEQ ID NO: 8.

In one embodiment, the anti-human GITR antibody comprises two heavy chains consisting of the amino acid sequence ranging from Q at position 1 to G at position 686 of SEQ ID NO: 7, wherein the Q is modified to pyroglutamate, and four light chains of SEQ ID NO: 8.

BRIEF DESCRIPTION OF THE DRAWINGS

FIG. 1A shows three GITR molecules (one labeled 101) embedded in a cell membrane (102). A cartoon of a traditional format antibody is shown binding just two GITR molecules (103).

FIG. 1B shows a cartoon of the tetravalent monospecific (TM) format antibodies disclosed herein: the left panel (105) shows a TM comprising two N-terminal IgG1 Fabs, with a C-terminal IgG4 S228P antibody; the right panel (106) shows a TM comprising two C-terminal IgG1 Fabs and an N-terminal IgG4 S228P antibody. The antigen binding domains are illustrated by open circles (107).

FIG. 1C shows a cartoon of the tetravalent bispecific format antibodies disclosed herein: the left panel (105) shows a bispecific antibody comprising two N-terminal IgG1 Fabs, with a C-terminal IgG4 S228P antibody; the right panel (106) shows a bispecific antibody comprising two C-terminal IgG1 Fabs and an N-terminal IgG4 S228P antibody. The antigen binding domains having specificity for two non-overlapping epitope specificities are illustrated by open circles (107 and 108).

FIG. 1D shows multimerization of GITR following binding of three illustrative tetravalent monospecific (TM) format ABPs. Such multimerization is expected to agonize GITR signaling, as described elsewhere in this disclosure.

FIG. 5A shows ABP43 (squares), ABP23 (circles), ABP24 (triangles), and ABP29 (open circles), ABP30 (open triangles), ABP31 (open circles), and ABP32 (open triangles), all in comparison to GITRL (+ sign). GITRL is shown as plus signs. IgG4 control is shown as X sign in each figure.

FIG. 5B shows ABP19 (N-terminal Fab, triangles)

and ABP25 (C terminal Fab, upside down triangles). GITRL is shown as plus signs. GITRL is shown as plus signs. IgG4 control is shown as X sign in each figure.

Figure 5A:
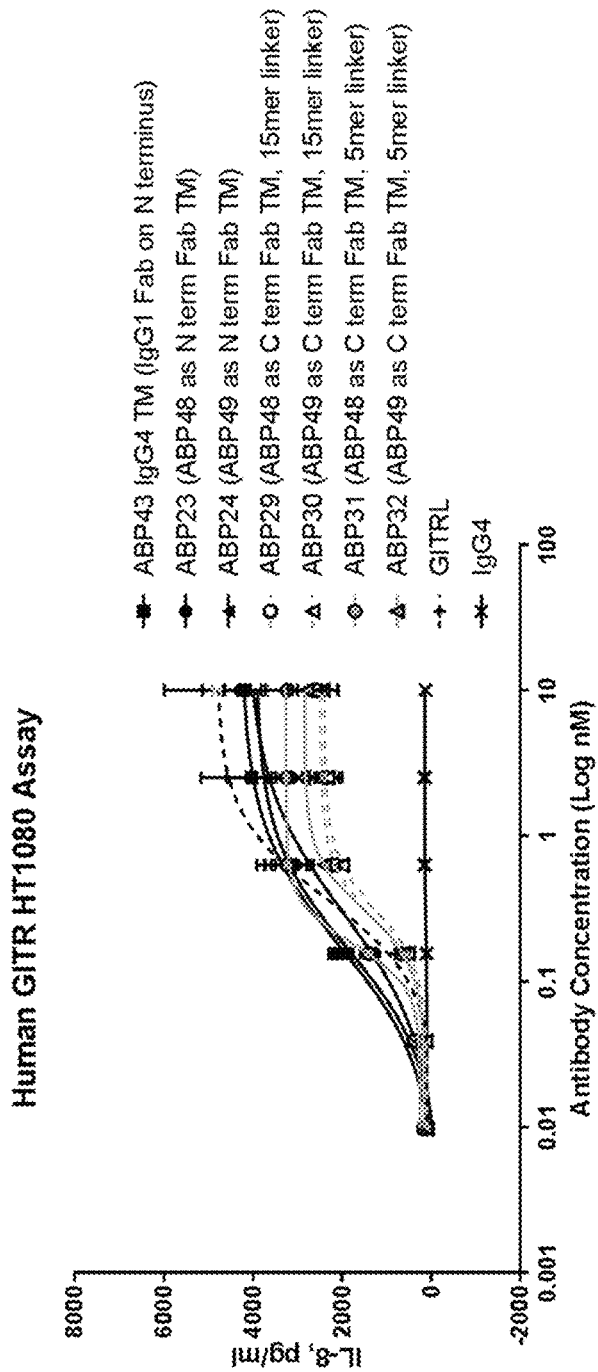
FIG. 5A is graphs comparing the agonist activity in GITR-expressing HT1080 cells of a parental N-terminal Fab TM format antibody, ABP43, to a number of further optimized antibodies having either N-terminal or C-terminal format.
Figure 5B:
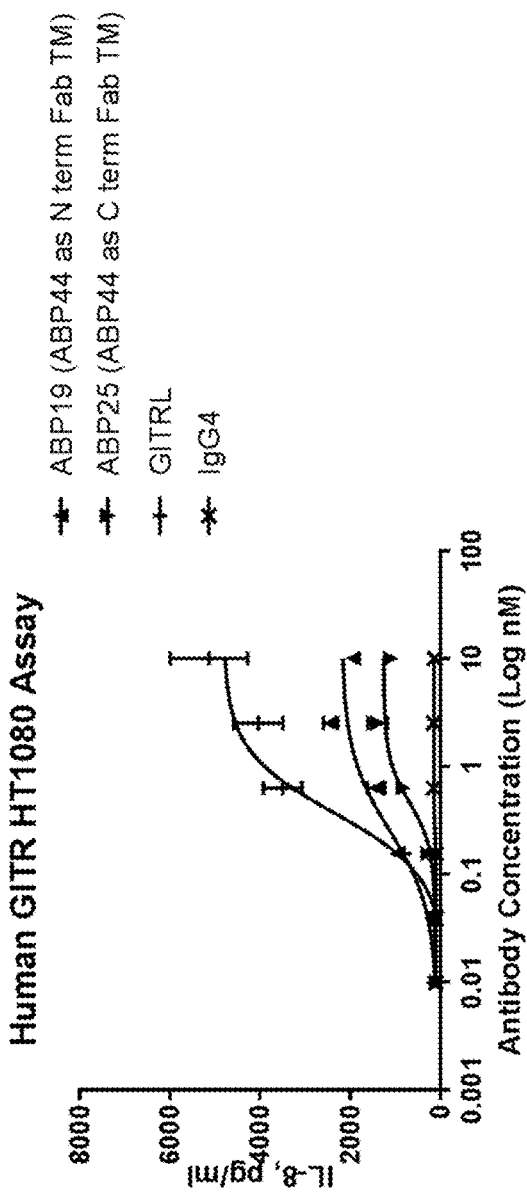
FIG. 5B is graphs comparing the agonist activity in GITR-expressing HT1080 cells of a parental N-terminal Fab TM format antibody, ABP43, to a number of further optimized antibodies having either N-terminal or C-terminal format.
Figure 5C:
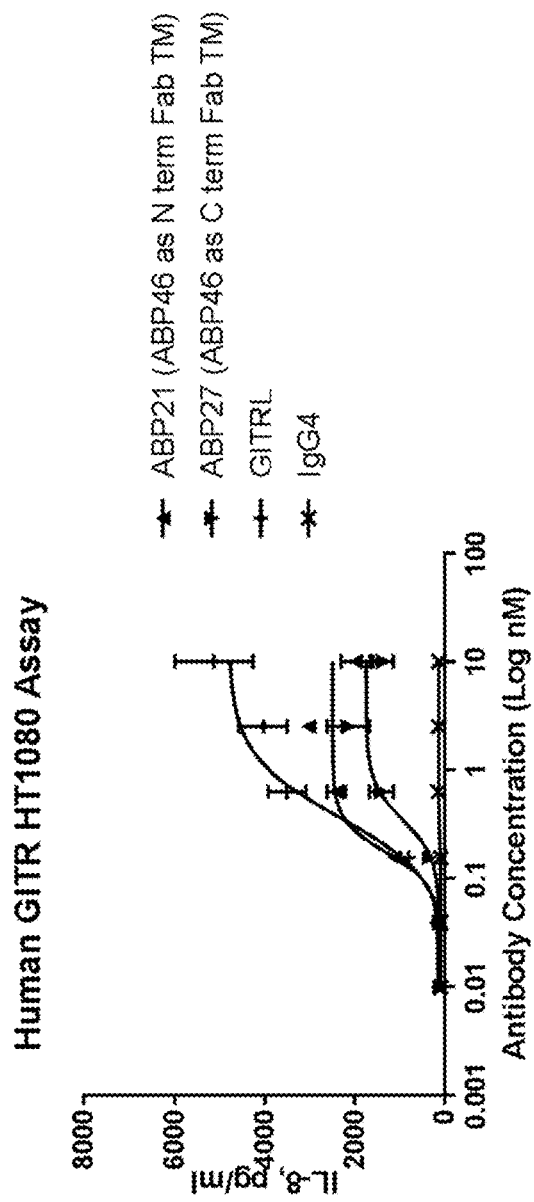

FIG. 5C is graphs comparing the agonist activity in GITR-expressing HT1080 cells of a parental N-terminal Fab TM format antibody, ABP43, to a number of further optimized antibodies having either N-terminal or C-terminal format. FIG. 5C shows ABP21 (N-terminal Fab, triangles) and ABP27 (C terminal Fab, upside down triangles). GITRL is shown as plus signs. GITRL is shown as plus signs. IgG4 control is shown as X sign in each figure.

Figure 5D:
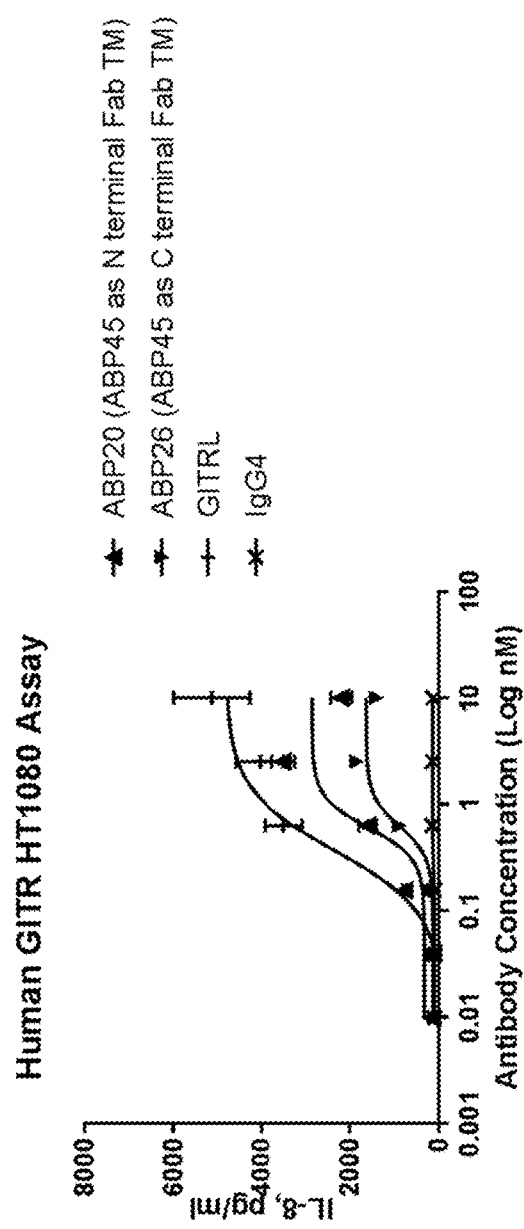

FIG. 5D is graphs comparing the agonist activity in GITR-expressing HT1080 cells of a parental N-terminal Fab TM format antibody, ABP43, to a number of further optimized antibodies having either N-terminal or C-terminal format. FIG. 5D shows ABP20 (N-terminal Fab, triangles) and ABP26 (C terminal Fab, upside down triangles). GITRL is shown as plus signs. GITRL is shown as plus signs. IgG4 control is shown as X sign in each figure.

Figure 5E:
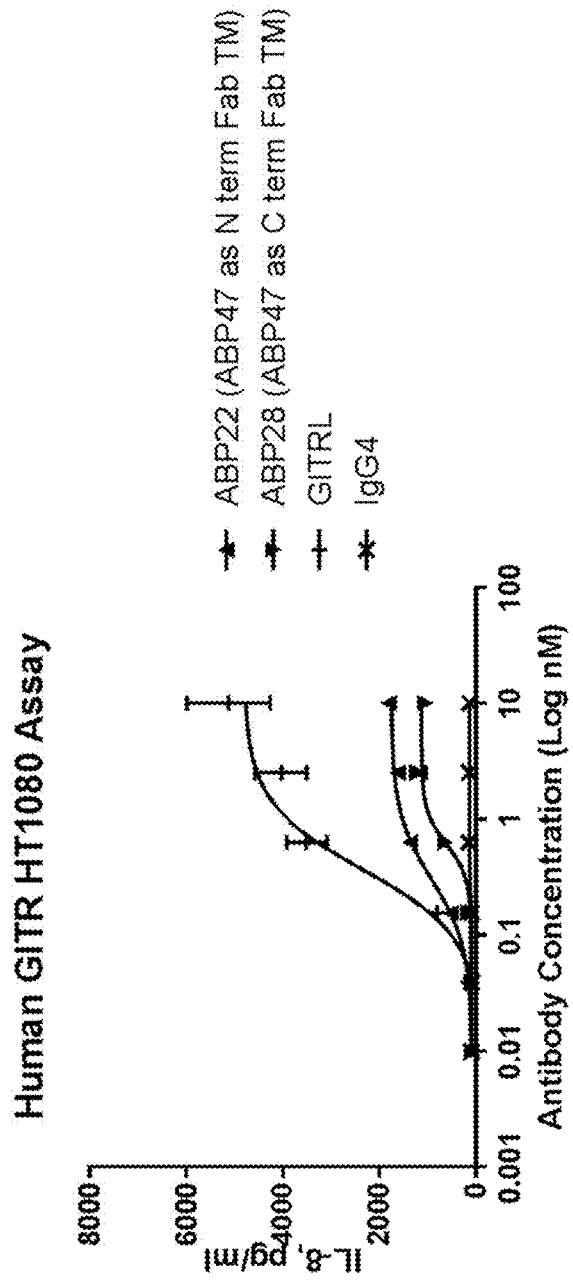

FIG. 5E is graphs comparing the agonist activity in GITR-expressing HT1080 cells of a parental N-terminal Fab TM format antibody, ABP43, to a number of further optimized antibodies having either N-terminal or C-terminal format. FIG. 5E shows ABP22 (N-terminal Fab, triangles) and ABP28 (C terminal Fab, upside down triangles). GITRL is shown as plus signs. IgG4 control is shown as X sign in each figure.

Figure 6:
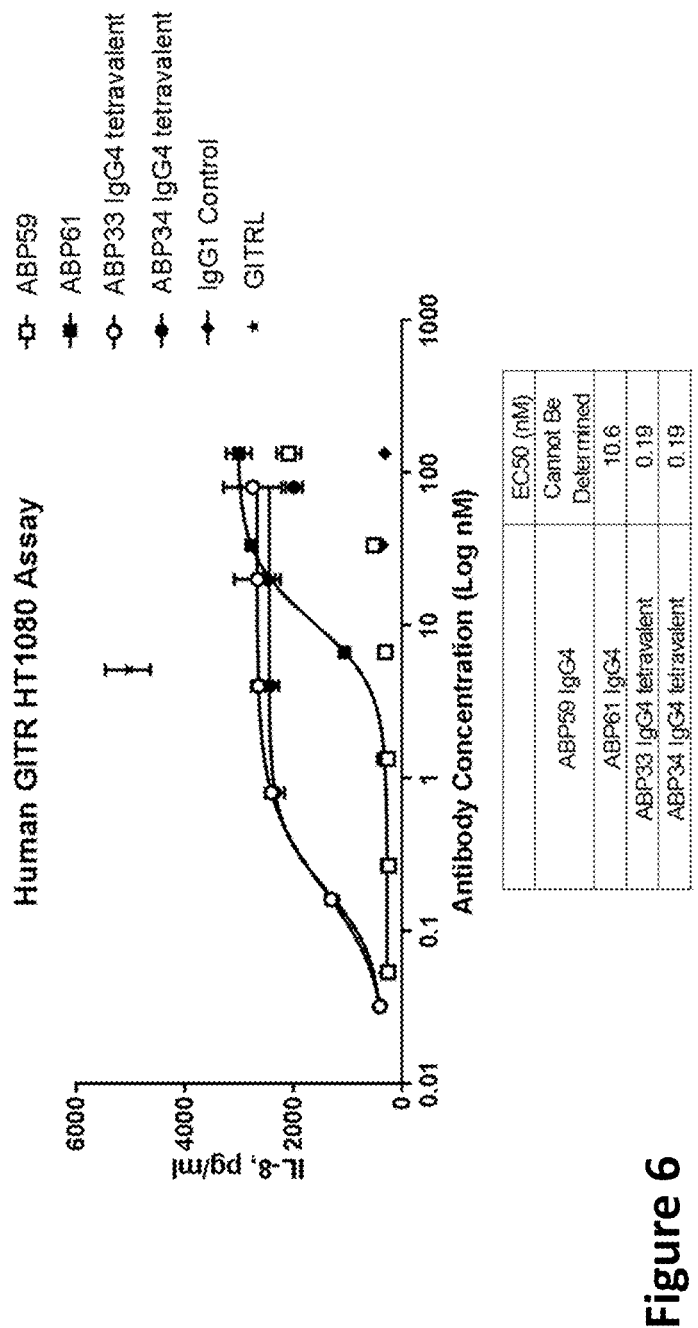

FIG. 6 shows the results of $EC_{50}$ determination for ABP33 and ABP34 in the HT1080 assay as described in the Examples. ABP33 (tetravalent version combining the IgG4 ABP61 with the IgG1 Fab of ABP58 on the N-terminus) and ABP34 (tetravalent version combining the IgG4 of ABP61 with the IgG1 Fab of ABP58 on the C-terminus) were compared to the bivalent ABPs 59 and 61 (IgG4 S228P), which were the basis for ABP33 and ABP34. As shown in the FIG., the bispecific tetravalent antibodies both had superior $EC_{50}$, as measured by IL-8 induction, when compared to the individual bivalent antibodies used to construct the bispecific tetravalent antibodies.

Figure 7A:
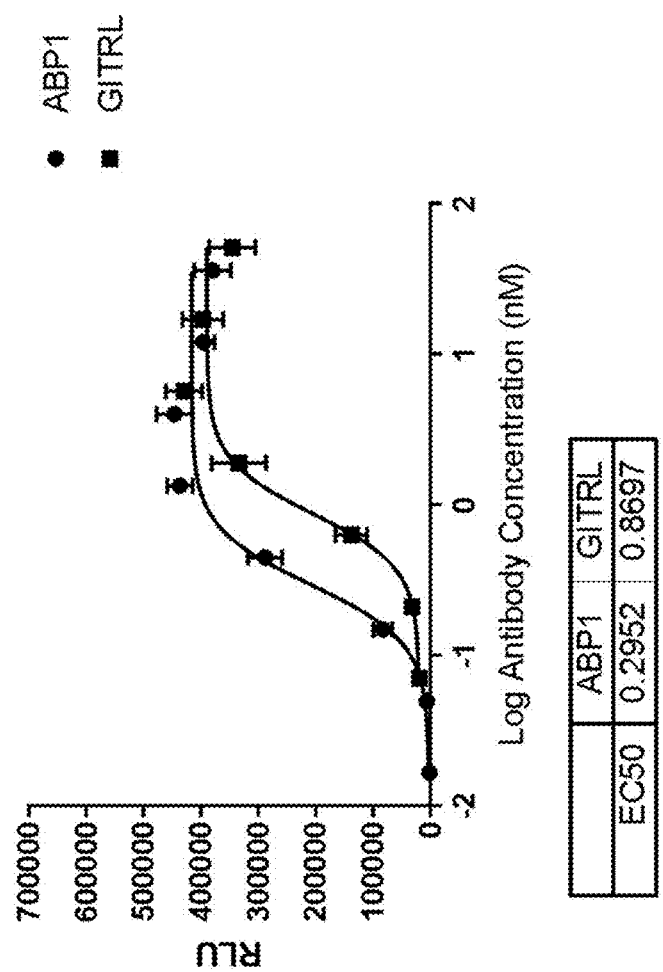

FIG. 7A shows the results of $EC_{50}$ determination in a Jurkat T cell assay as described for the HT1080 cells above. Optimized N terminal Fab TM format ABPs were compared to GITRL for their ability to agonize GITR, as measured by IL-8 production. FIG. 7A shows ABP 1.

Figure 7B:
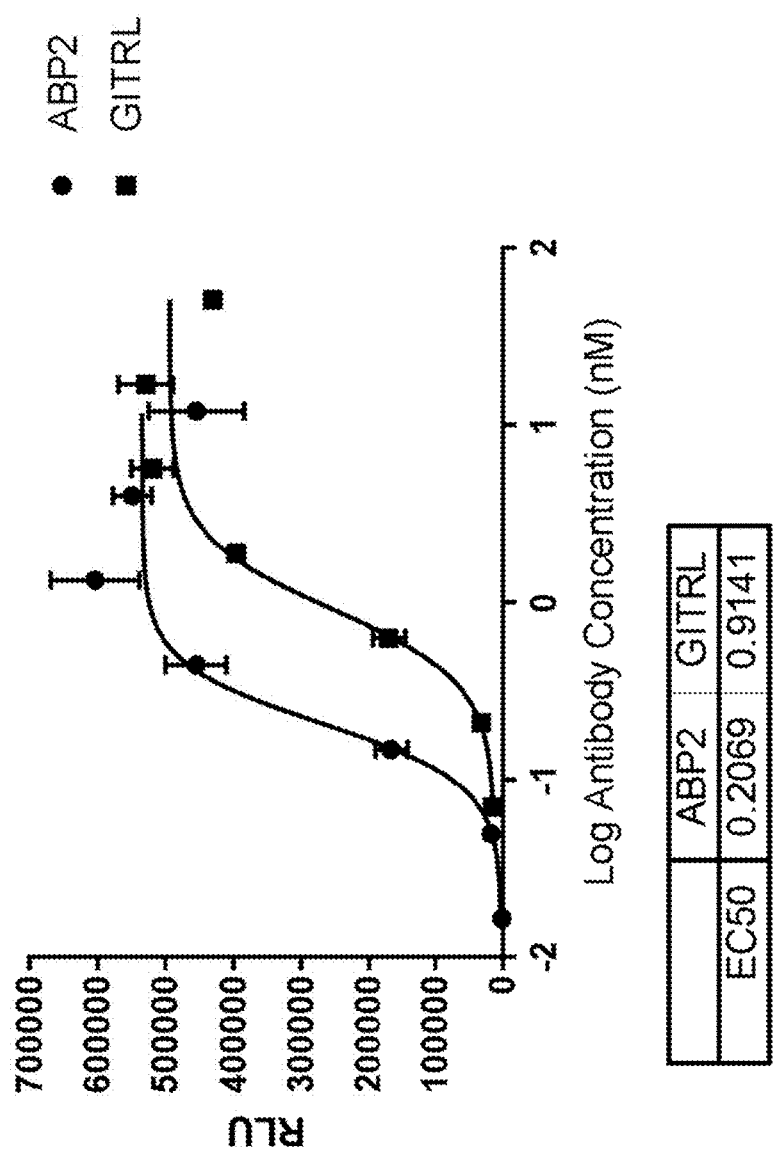

FIG. 7B shows the results of $EC_{50}$ determination in a Jurkat T cell assay as described for the HT1080 cells above. Optimized N terminal Fab TM format ABPs were compared to GITRL for their ability to agonize GITR, as measured by IL-8 production. FIG. 7B shows ABP 2.

Figure 7C:
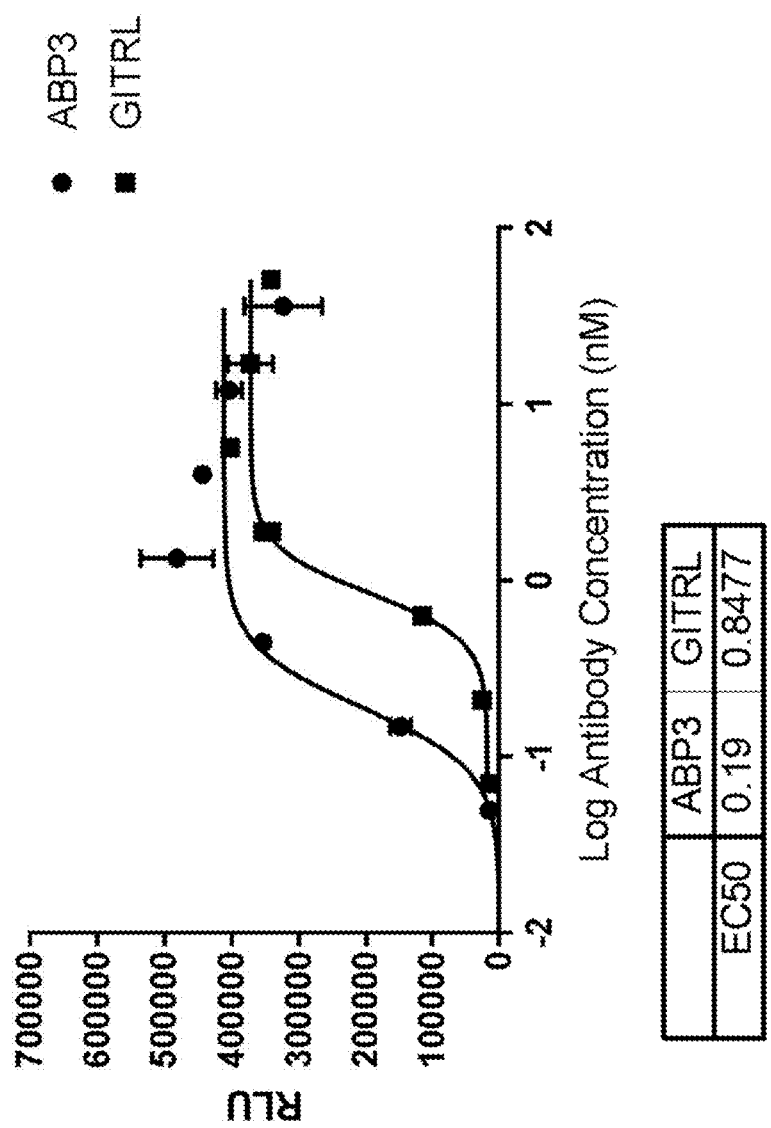

FIG. 7C shows the results of $EC_{50}$ determination in a Jurkat T cell assay as described for the HT1080 cells above. Optimized N terminal Fab TM format ABPs were compared to GITRL for their ability to agonize GITR, as measured by IL-8 production. FIG. 7C shows ABP 3.

Figure 7D:
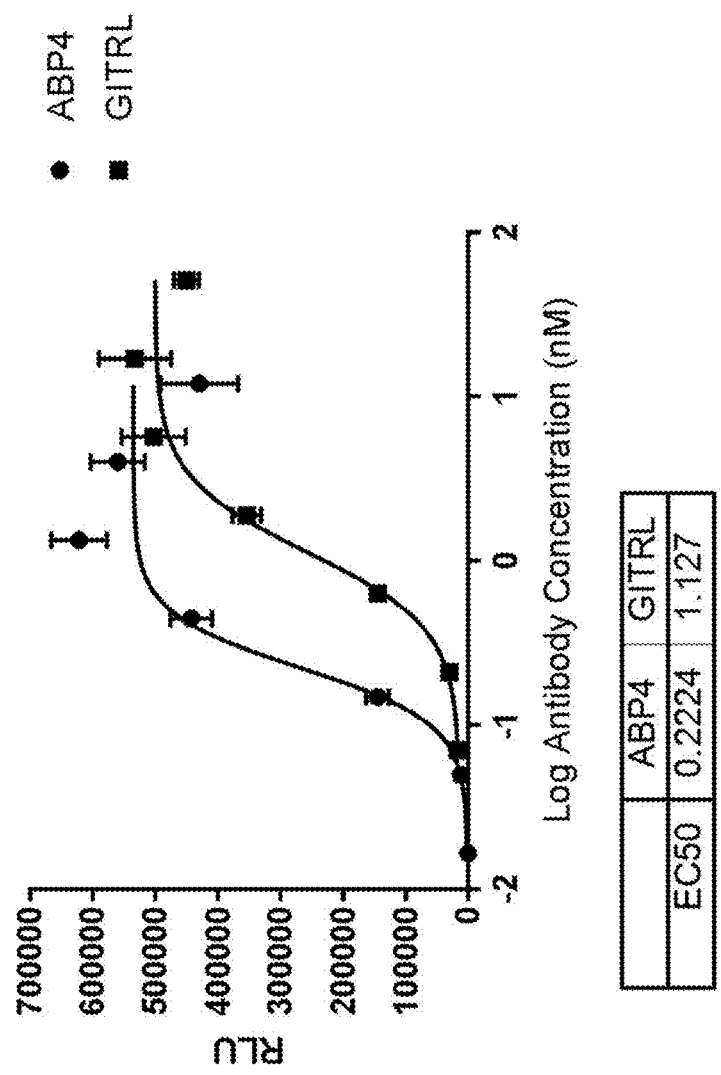

FIG. 7D shows the results of $EC_{50}$ determination in a Jurkat T cell assay as described for the HT1080 cells above. Optimized N terminal Fab TM format ABPs were compared to GITRL for their ability to agonize GITR, as measured by IL-8 production. FIG. 7D shows ABP 4.

Figure 7E:
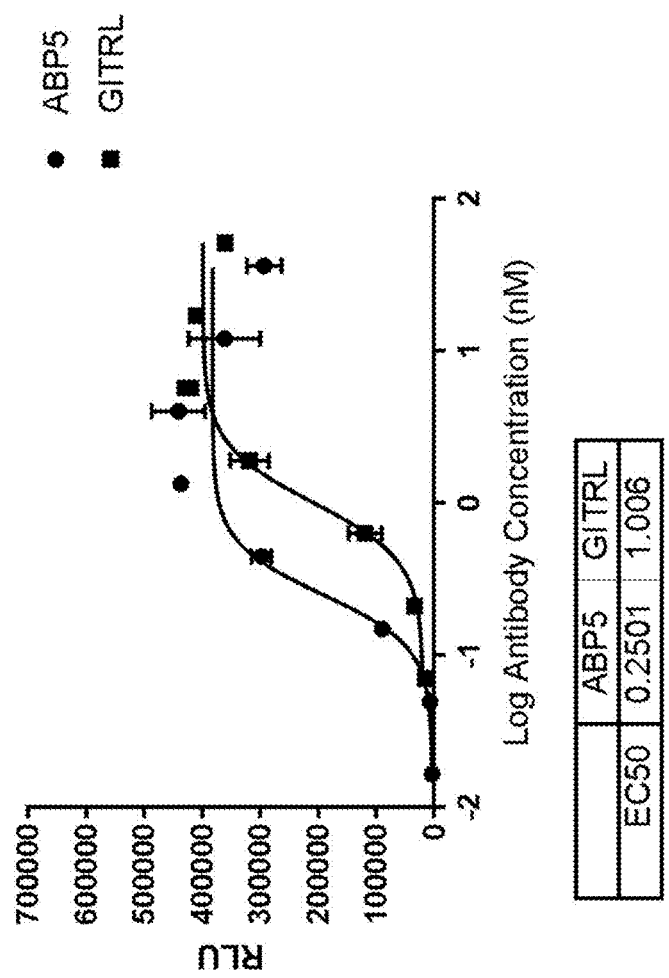

FIG. 7E shows the results of $EC_{50}$ determination in a Jurkat T cell assay as described for the HT1080 cells above. Optimized N terminal Fab TM format ABPs were compared to GITRL for their ability to agonize GITR, as measured by IL-8 production. FIG. 7E shows ABP 5.

Figure 7F:
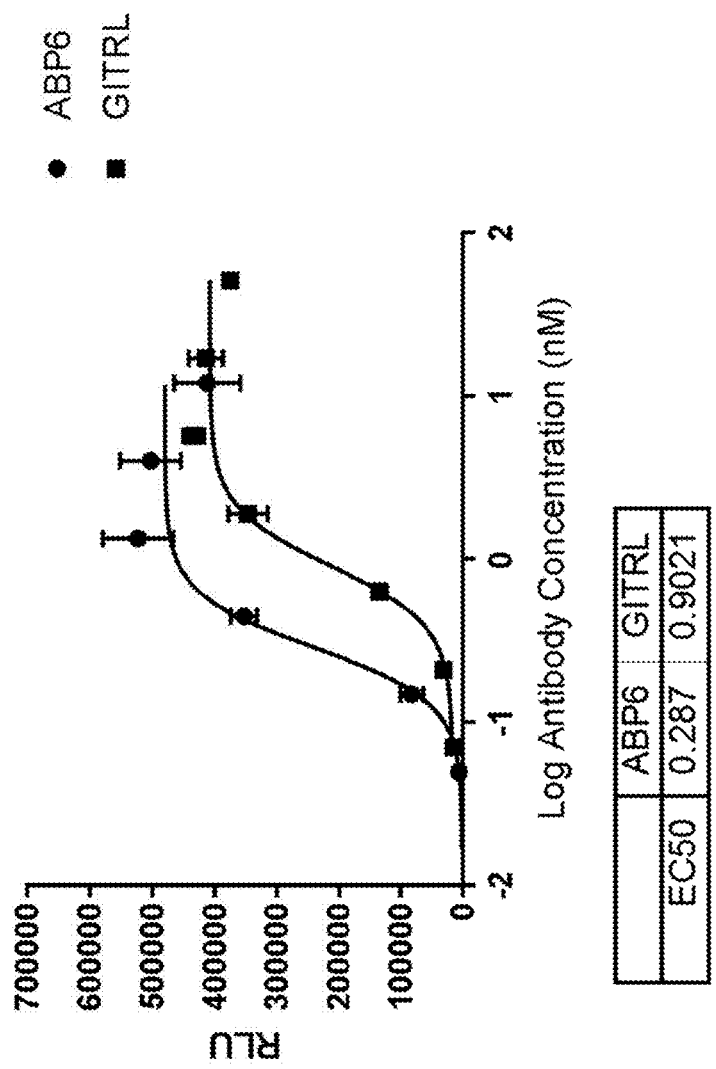

FIG. 7F shows the results of $EC_{50}$ determination in a Jurkat T cell assay as described for the HT1080 cells above. Optimized N terminal Fab TM format ABPs were compared to GITRL for their ability to agonize GITR, as measured by IL-8 production. FIG. 7F shows ABP 6.

Figure 7G:
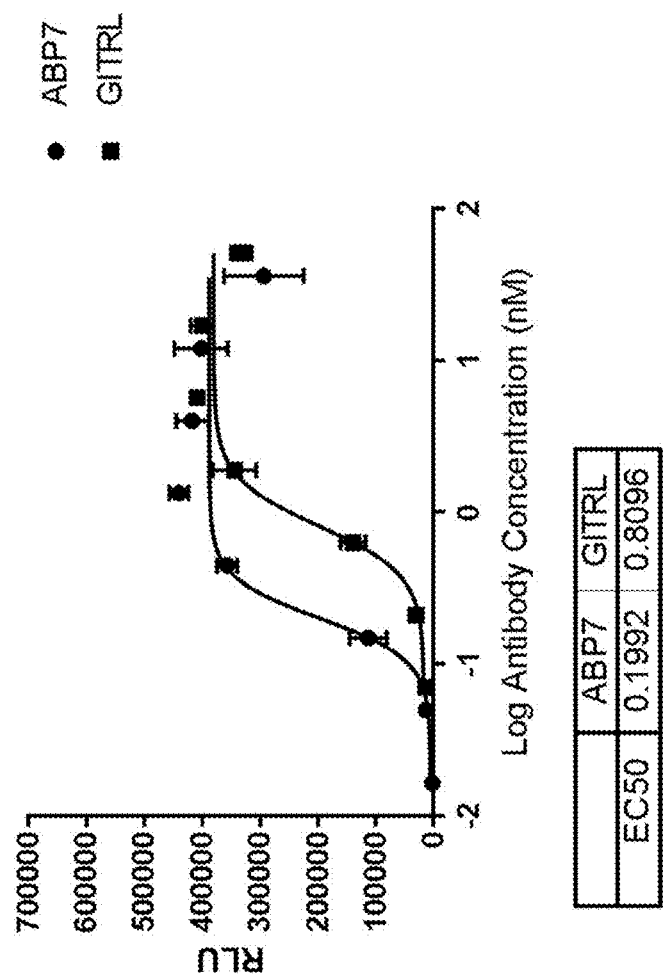

FIG. 7G shows the results of $EC_{50}$ determination in a Jurkat T cell assay as described for the HT1080 cells above. Optimized N terminal Fab TM format ABPs were compared to GITRL for their ability to agonize GITR, as measured by IL-8 production. FIG. 7G shows ABP 7.

Figure 7H:
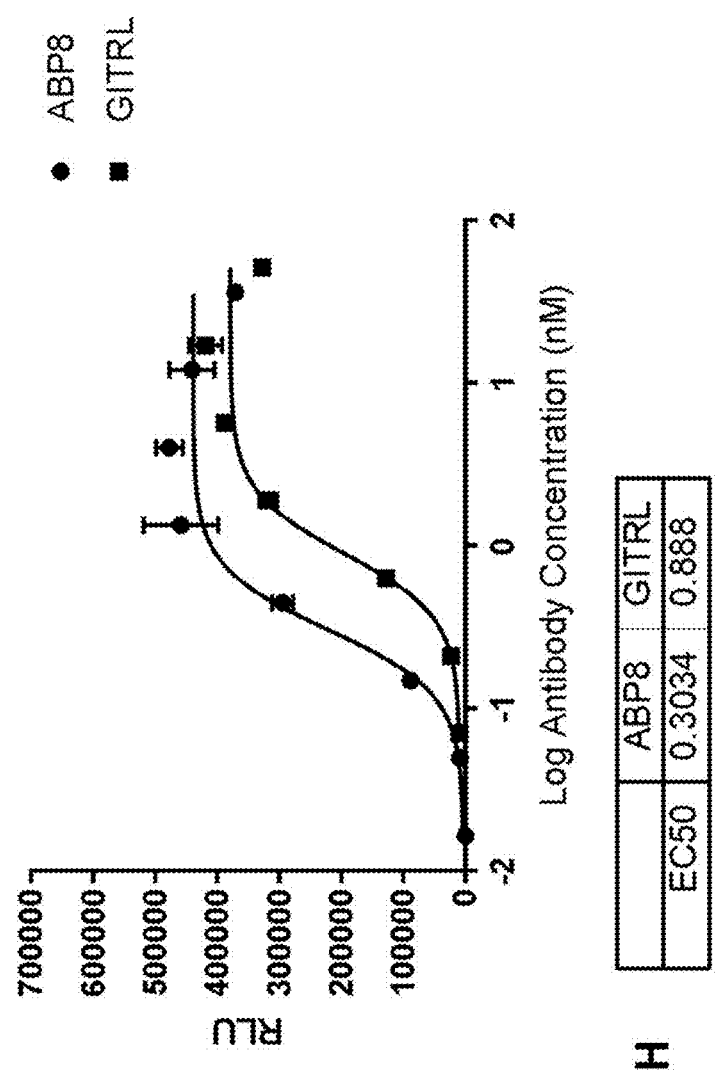

FIG. 7H shows the results of $EC_{50}$ determination in a Jurkat T cell assay as described for the HT1080 cells above. Optimized N terminal Fab TM format ABPs were compared to GITRL for their ability to agonize GITR, as measured by IL-8 production. FIG. 7H shows ABP 8.

Figure 8A:
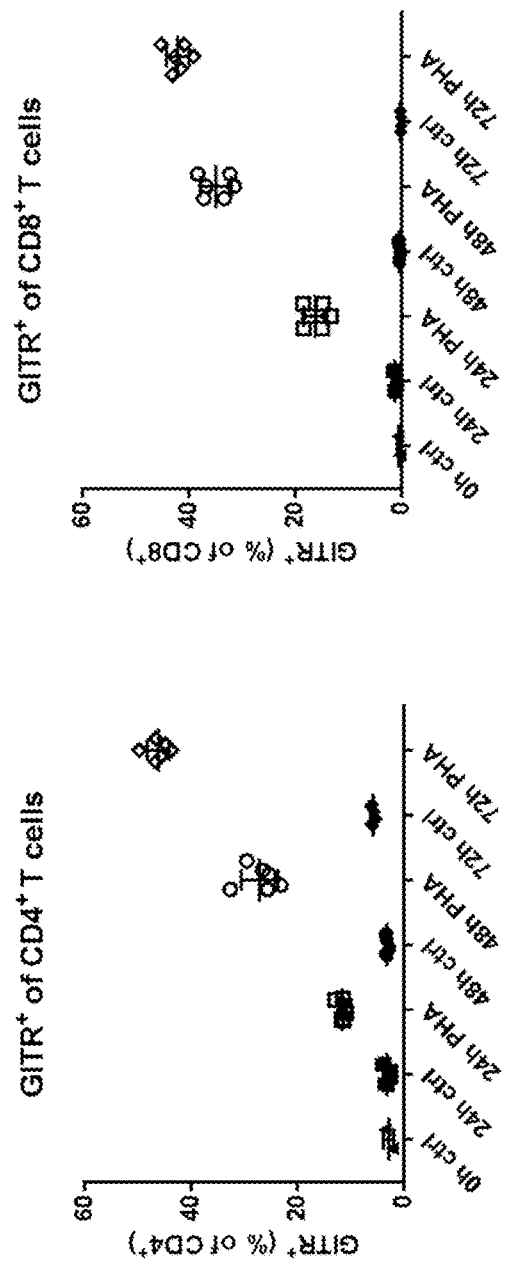

FIG. 8A shows FACS analysis from triplicate quantifications of T cells isolated from two human donors, and shows the percentage of GITR+CD4+ cells (left) and CD8+ cells (right) at various time points, +/−stimulation with PHA.

Figure 8B:
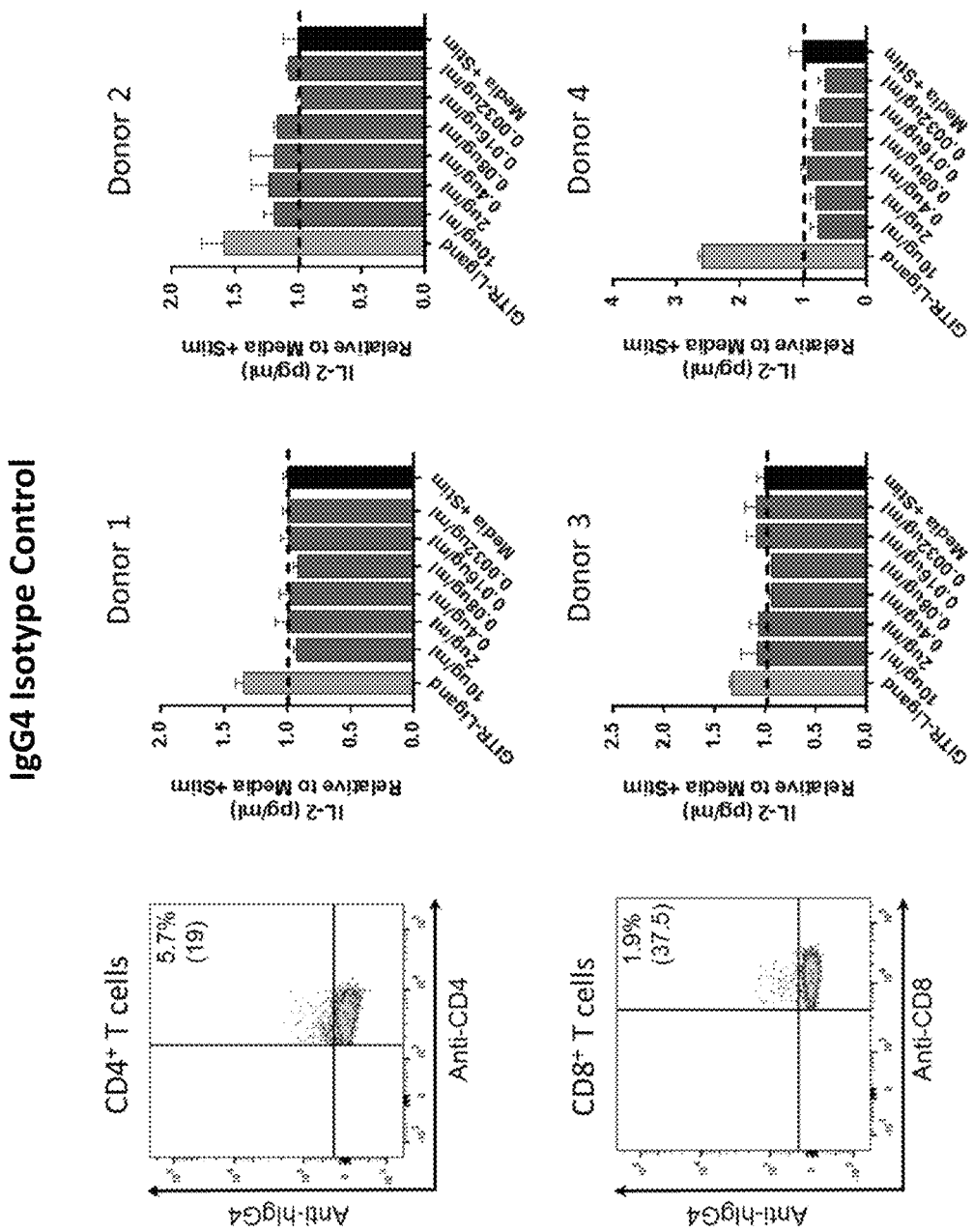

FIG. 8B show results of treatment of T-blasts from 4 different donors treated with controls or ABPs and the resultant IL-2 production (data normalized to levels of IL-2 production achieved in control media). In the FIG. the top row, from left to right is FACS measurement of the ABP binding to CD4+ cells, IL-2 production in cells from Donor 1, IL-2 production in cells from Donor 2. In the bottom row, from left to right, is FACS measurement of the ABP binding to CD8+ cells, IL-2 production in cells from Donor 3, IL-2 production in cells from Donor 4. Shown are data as follows: FIG. 8B: IgG4 isotype control.

Figure 8C:
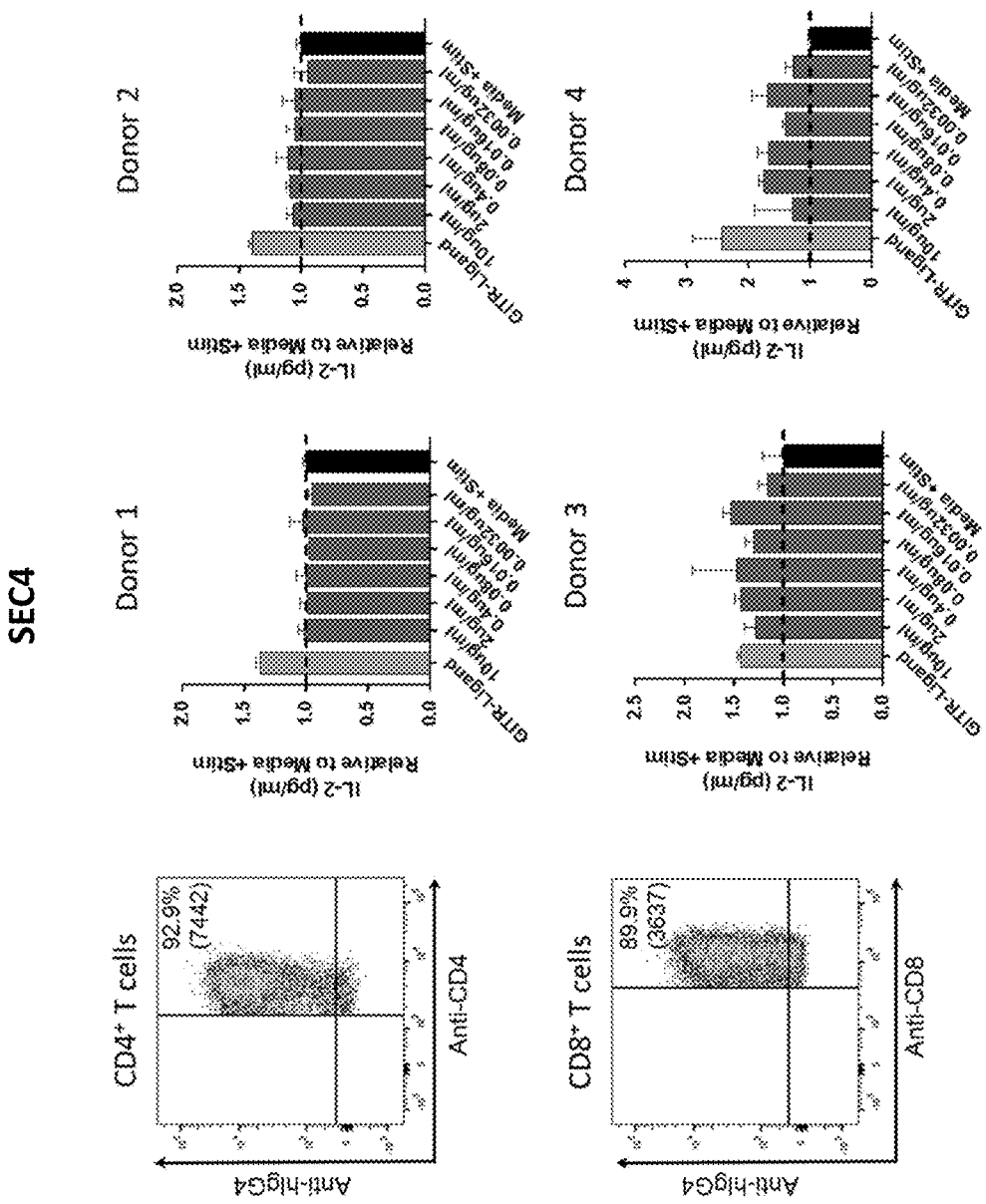

FIG. 8C show results of treatment of T-blasts from 4 different donors treated with controls or ABPs and the resultant IL-2 production (data normalized to levels of IL-2 production achieved in control media). In the FIG. the top row, from left to right is FACS measurement of the ABP binding to CD4+ cells, IL-2 production in cells from Donor 1, IL-2 production in cells from Donor 2. In the bottom row, from left to right, is FACS measurement of the ABP binding to CD8+ cells, IL-2 production in cells from Donor 3, IL-2 production in cells from Donor 4. Shown are data as follows: FIG. 8C: SEC4 antibody.

Figure 8D:
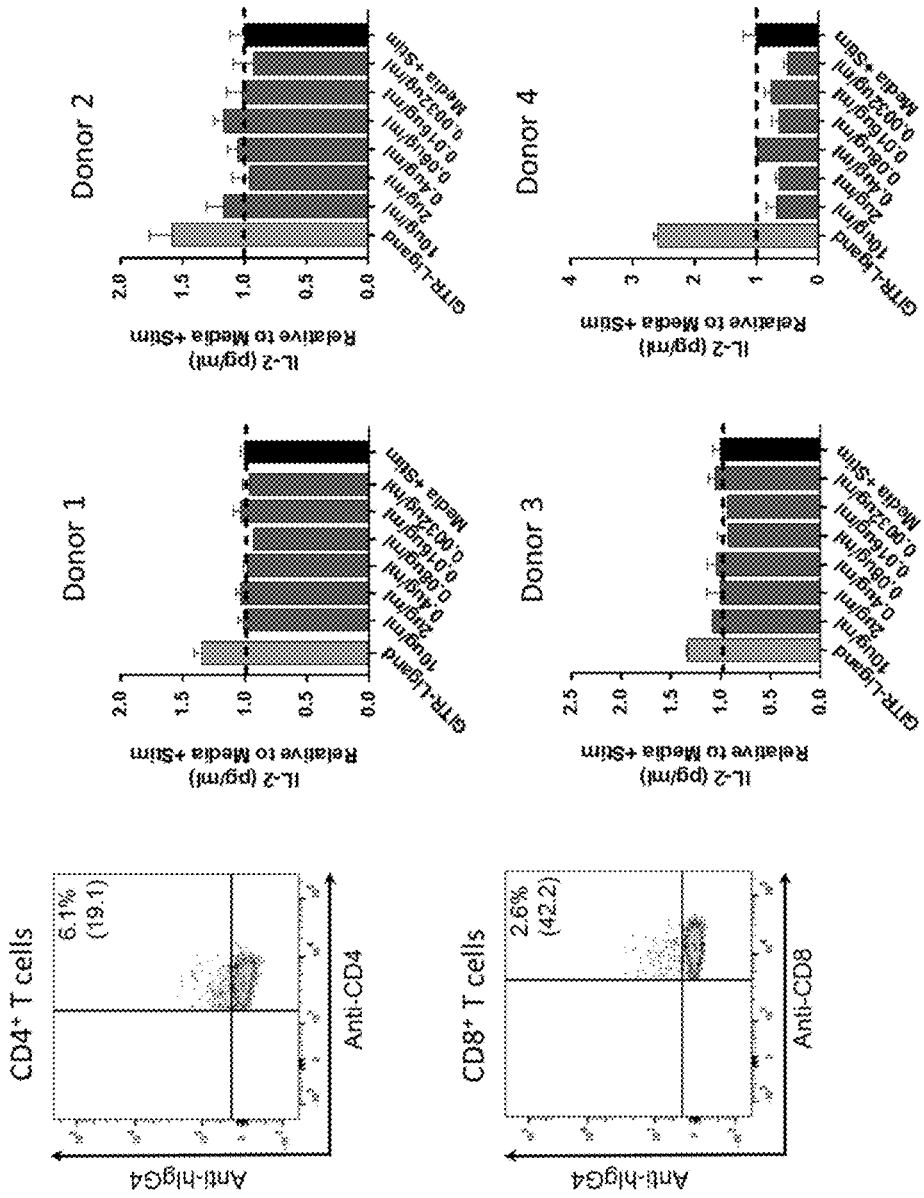

FIG. 8D show results of treatment of T-blasts from 4 different donors treated with controls or ABPs and the resultant IL-2 production (data normalized to levels of IL-2 production achieved in control media). In the FIG. the top row, from left to right is FACS measurement of the ABP binding to CD4+ cells, IL-2 production in cells from Donor 1, IL-2 production in cells from Donor 2. In the bottom row, from left to right, is FACS measurement of the ABP binding to CD8+ cells, IL-2 production in cells from Donor 3, IL-2 production in cells from Donor 4. Shown are data as follows: FIG. 8D: IgG4 TM format negative control.

Figure 8E:
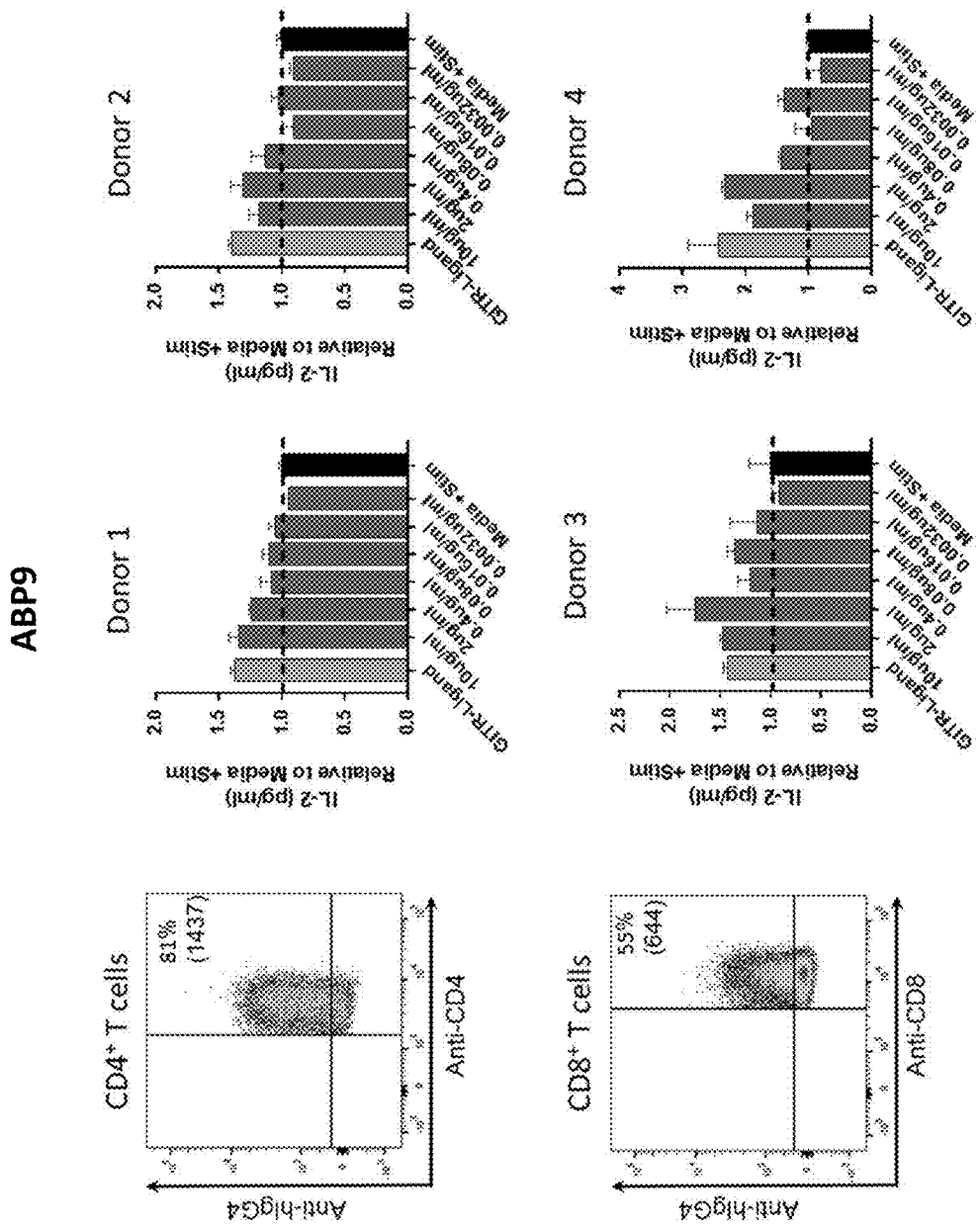

FIG. 8E show results of treatment of T-blasts from 4 different donors treated with controls or ABPs and the resultant IL-2 production (data normalized to levels of IL-2 production achieved in control media). In the FIG. the top row, from left to right is FACS measurement of the ABP binding to CD4+ cells, IL-2 production in cells from Donor 1, IL-2 production in cells from Donor 2. In the bottom row, from left to right, is FACS measurement of the ABP binding to CD8+ cells, IL-2 production in cells from Donor 3, IL-2 production in cells from Donor 4. Shown are data as follows: FIG. 8E: ABP9 (TM Format IgG4 non-optimized parent of ABPs 1-8).

Figure 8F:
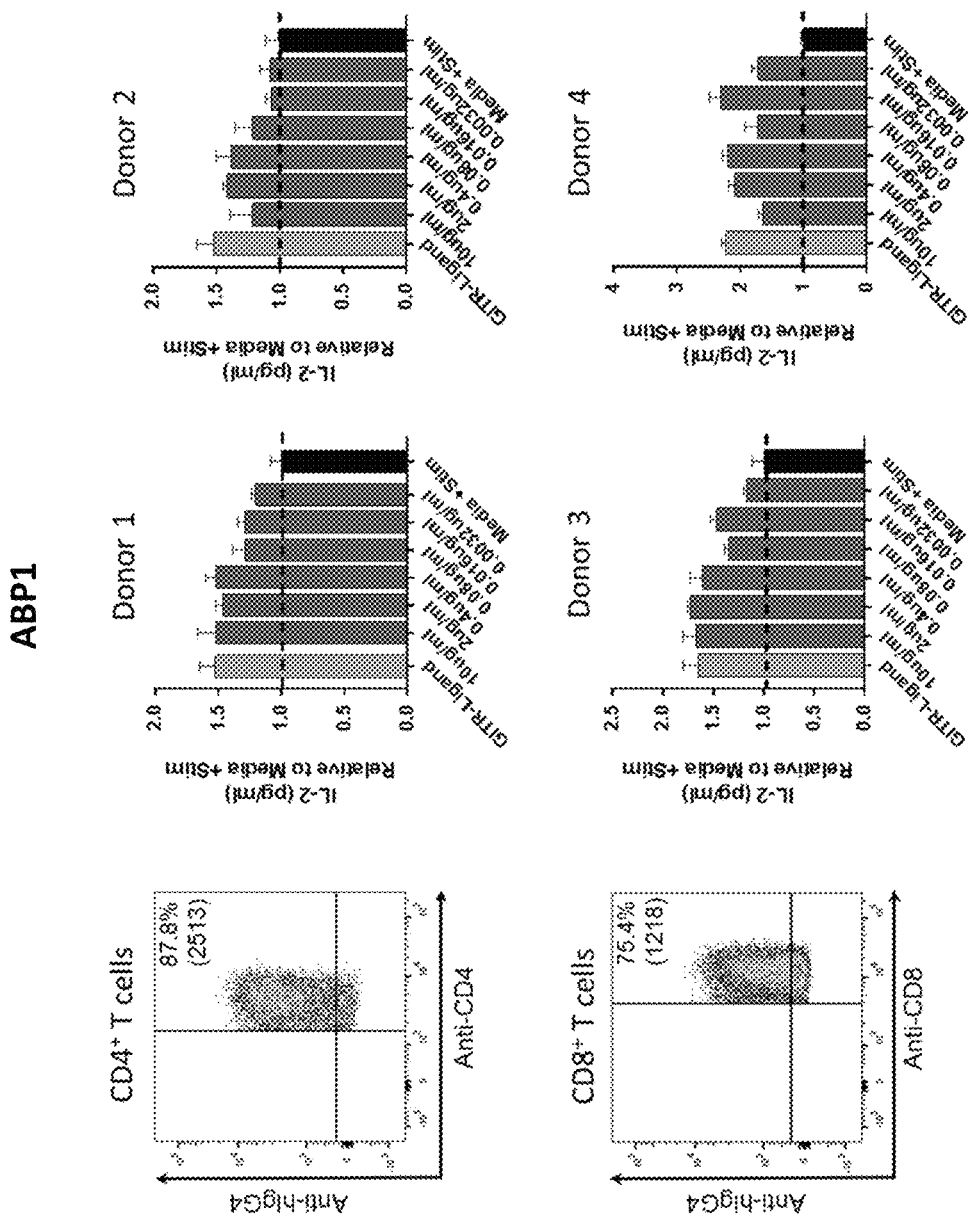

FIG. 8F show results of treatment of T-blasts from 4 different donors treated with controls or ABPs and the resultant IL-2 production (data normalized to levels of IL-2 production achieved in control media). In the FIG. the top row, from left to right is FACS measurement of the ABP binding to CD4+ cells, IL-2 production in cells from Donor 1, IL-2 production in cells from Donor 2. In the bottom row, from left to right, is FACS measurement of the ABP binding to CD8+ cells, IL-2 production in cells from Donor 3, IL-2 production in cells from Donor 4. Shown are data as follows: FIG. 8F: ABP1.

Figure 8G:
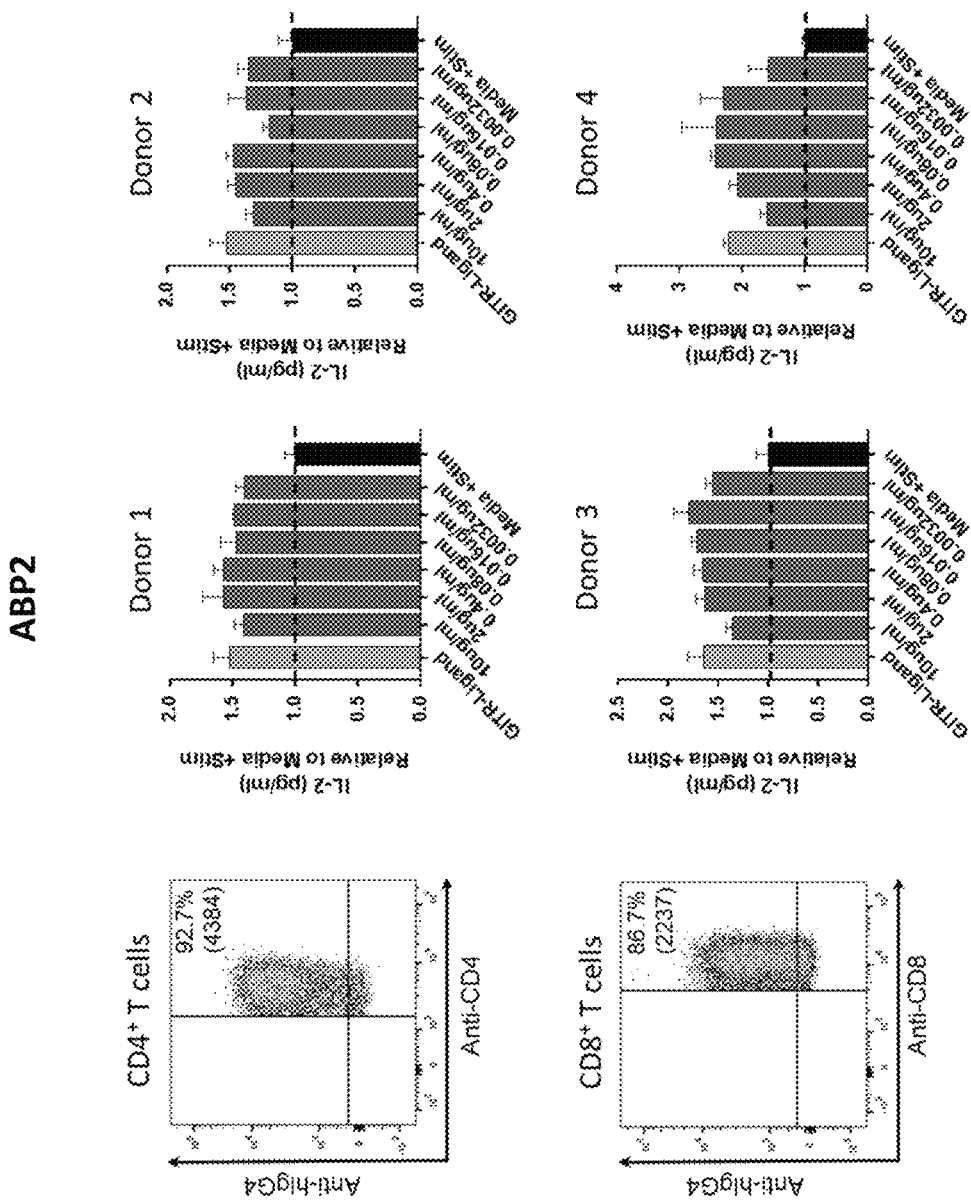

FIG. 8G show results of treatment of T-blasts from 4 different donors treated with controls or ABPs and the resultant IL-2 production (data normalized to levels of IL-2 production achieved in control media). In the FIG. the top row, from left to right is FACS measurement of the ABP binding to CD4+ cells, IL-2 production in cells from Donor 1, IL-2 production in cells from Donor 2. In the bottom row, from left to right, is FACS measurement of the ABP binding to CD8+ cells, IL-2 production in cells from Donor 3, IL-2 production in cells from Donor 4. Shown are data as follows: FIG. 8G: ABP2.

Figure 8H:
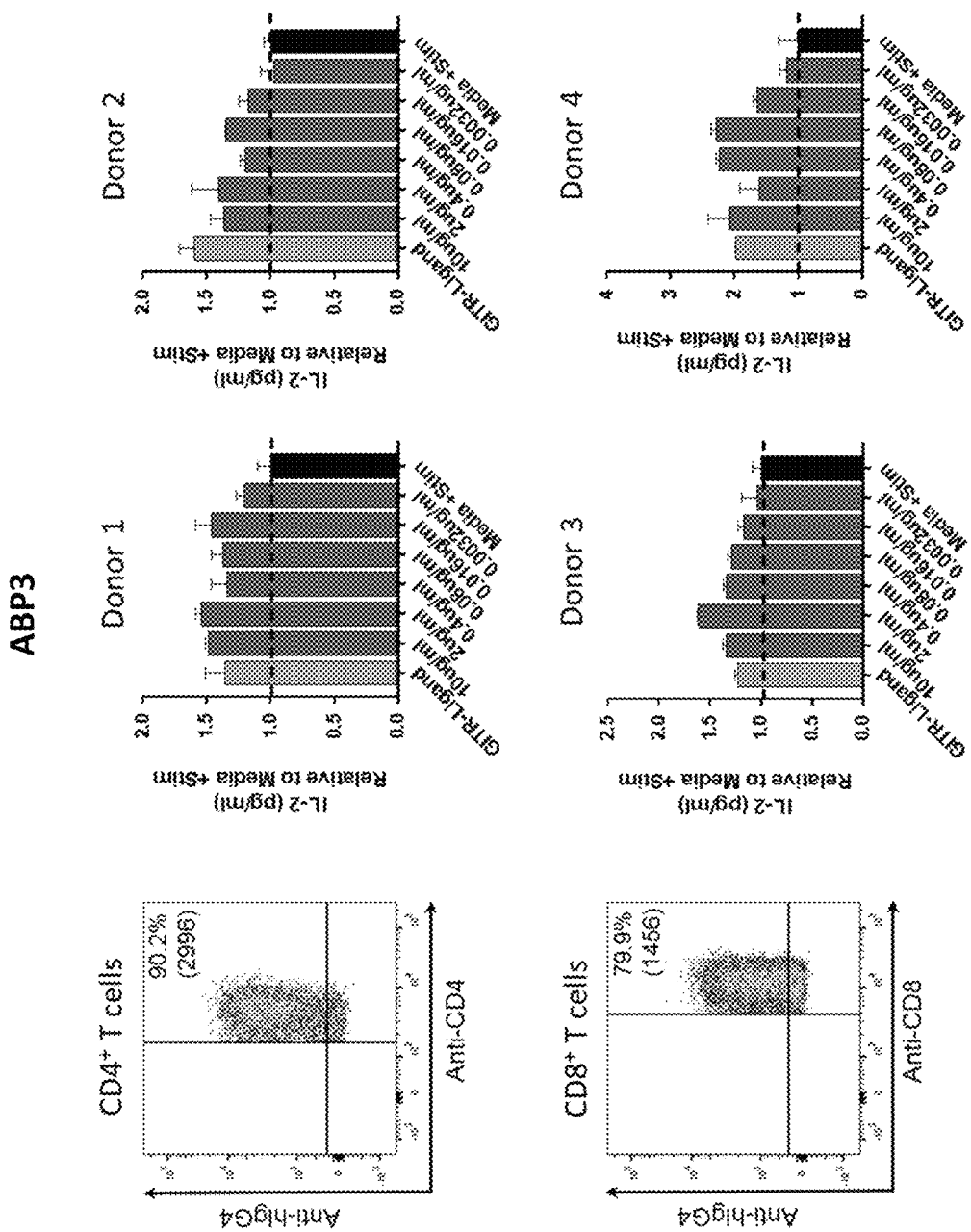

FIG. 8H show results of treatment of T-blasts from 4 different donors treated with controls or ABPs and the resultant IL-2 production (data normalized to levels of IL-2 production achieved in control media). In the FIG. the top row, from left to right is FACS measurement of the ABP binding to CD4+ cells, IL-2 production in cells from Donor 1, IL-2 production in cells from Donor 2. In the bottom row, from left to right, is FACS measurement of the ABP binding to CD8+ cells, IL-2 production in cells from Donor 3, IL-2 production in cells from Donor 4. Shown are data as follows: FIG. 8H: ABP3.

Figure 8I:
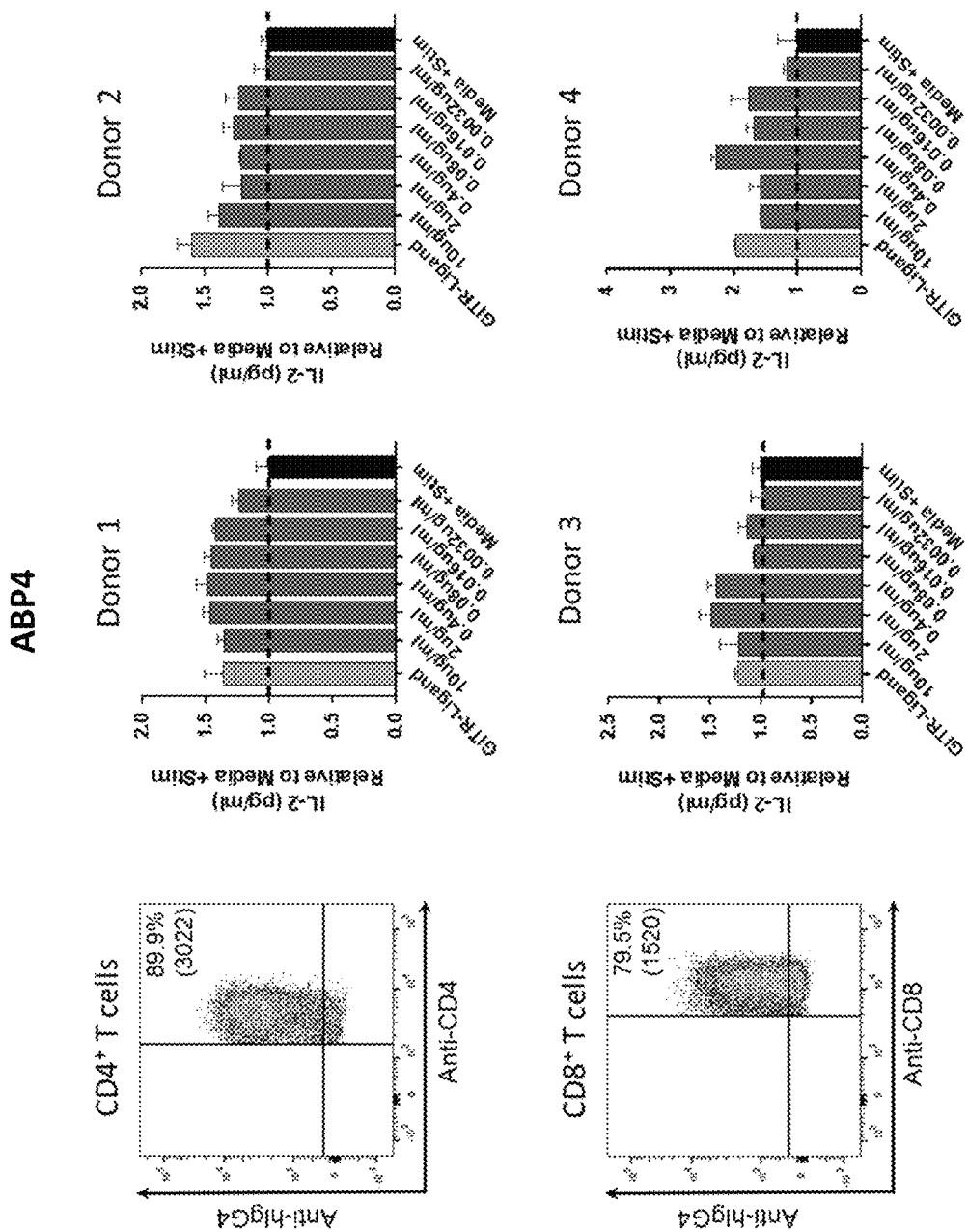

FIG. 8I show results of treatment of T-blasts from 4 different donors treated with controls or ABPs and the resultant IL-2 production (data normalized to levels of IL-2 production achieved in control media). In the FIG. the top row, from left to right is FACS measurement of the ABP binding to CD4+ cells, IL-2 production in cells from Donor 1, IL-2 production in cells from Donor 2. In the bottom row, from left to right, is FACS measurement of the ABP binding to CD8+ cells, IL-2 production in cells from Donor 3, IL-2 production in cells from Donor 4. Shown are data as follows: FIG. 8I: ABP4.

Figure 8J:
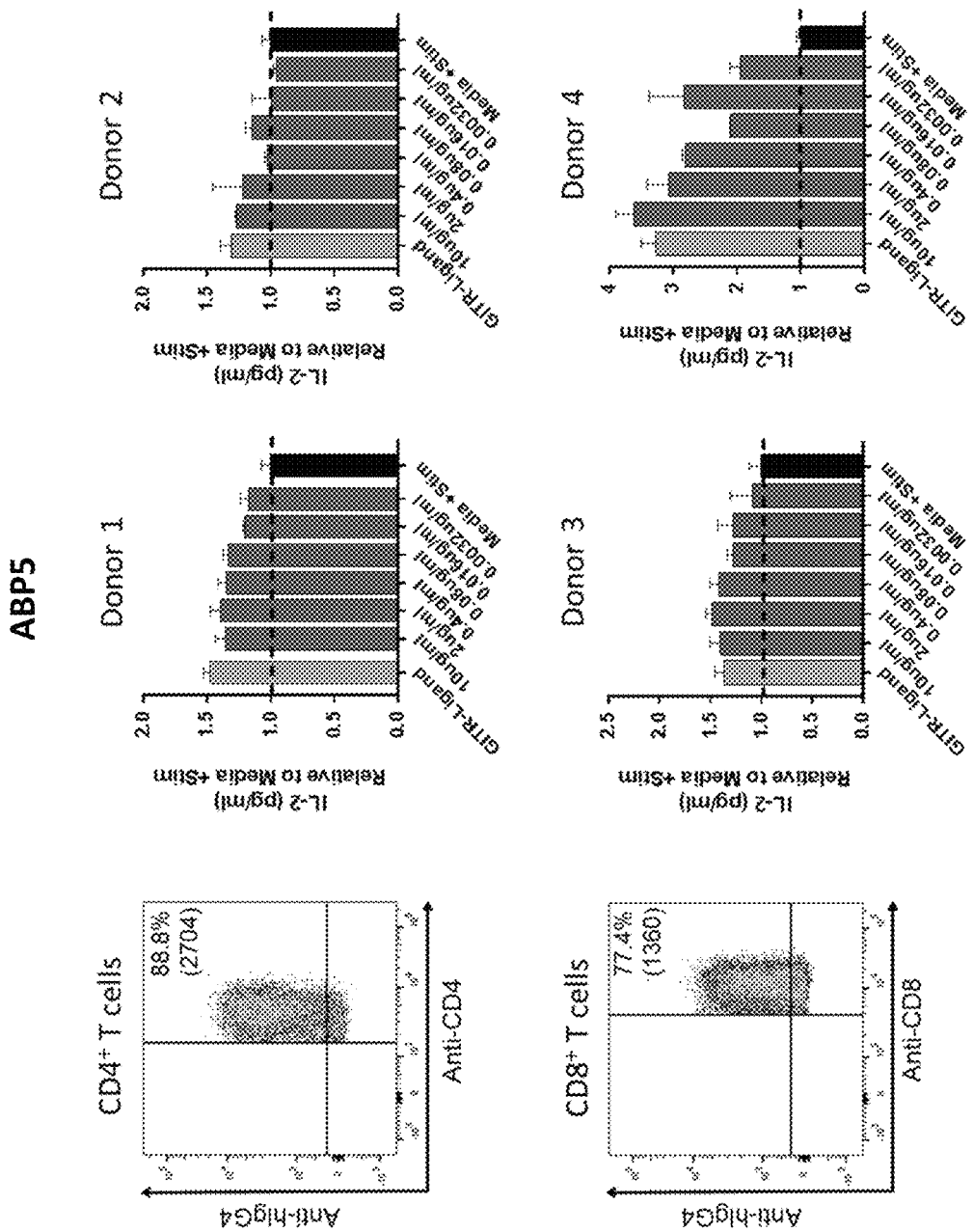

FIG. 8J show results of treatment of T-blasts from 4 different donors treated with controls or ABPs and the resultant IL-2 production (data normalized to levels of IL-2 production achieved in control media). In the FIG. the top row, from left to right is FACS measurement of the ABP binding to CD4+ cells, IL-2 production in cells from Donor 1, IL-2 production in cells from Donor 2. In the bottom row, from left to right, is FACS measurement of the ABP binding to CD8+ cells, IL-2 production in cells from Donor 3, IL-2 production in cells from Donor 4. Shown are data as follows: FIG. 8J: ABP5.

Figure 8K:
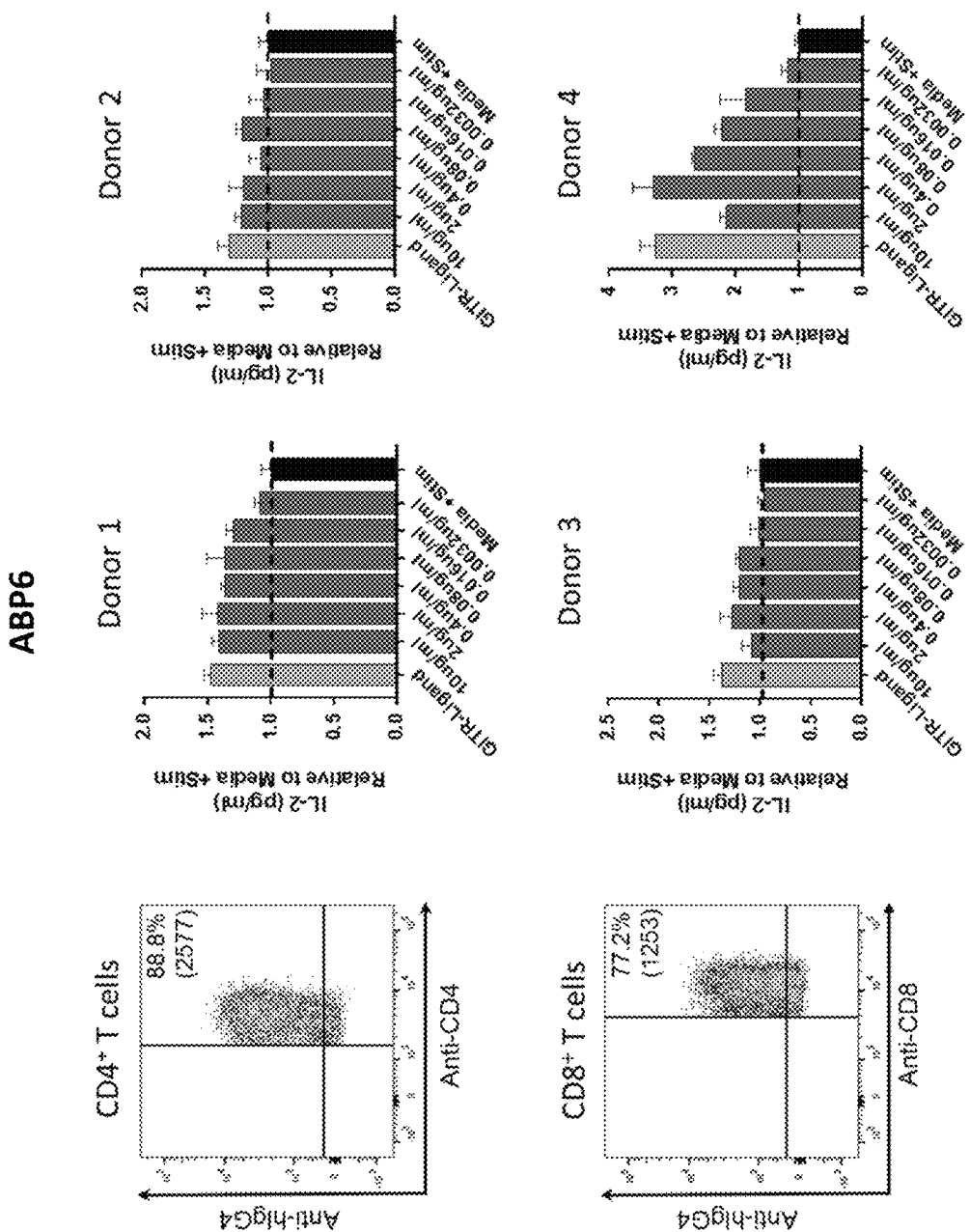

FIG. 8K show results of treatment of T-blasts from 4 different donors treated with controls or ABPs and the resultant IL-2 production (data normalized to levels of IL-2 production achieved in control media). In the FIG. the top row, from left to right is FACS measurement of the ABP binding to CD4+ cells, IL-2 production in cells from Donor 1, IL-2 production in cells from Donor 2. In the bottom row, from left to right, is FACS measurement of the ABP binding to CD8+ cells, IL-2 production in cells from Donor 3, IL-2 production in cells from Donor 4. Shown are data as follows: FIG. 8K: ABP6.

Figure 8L:
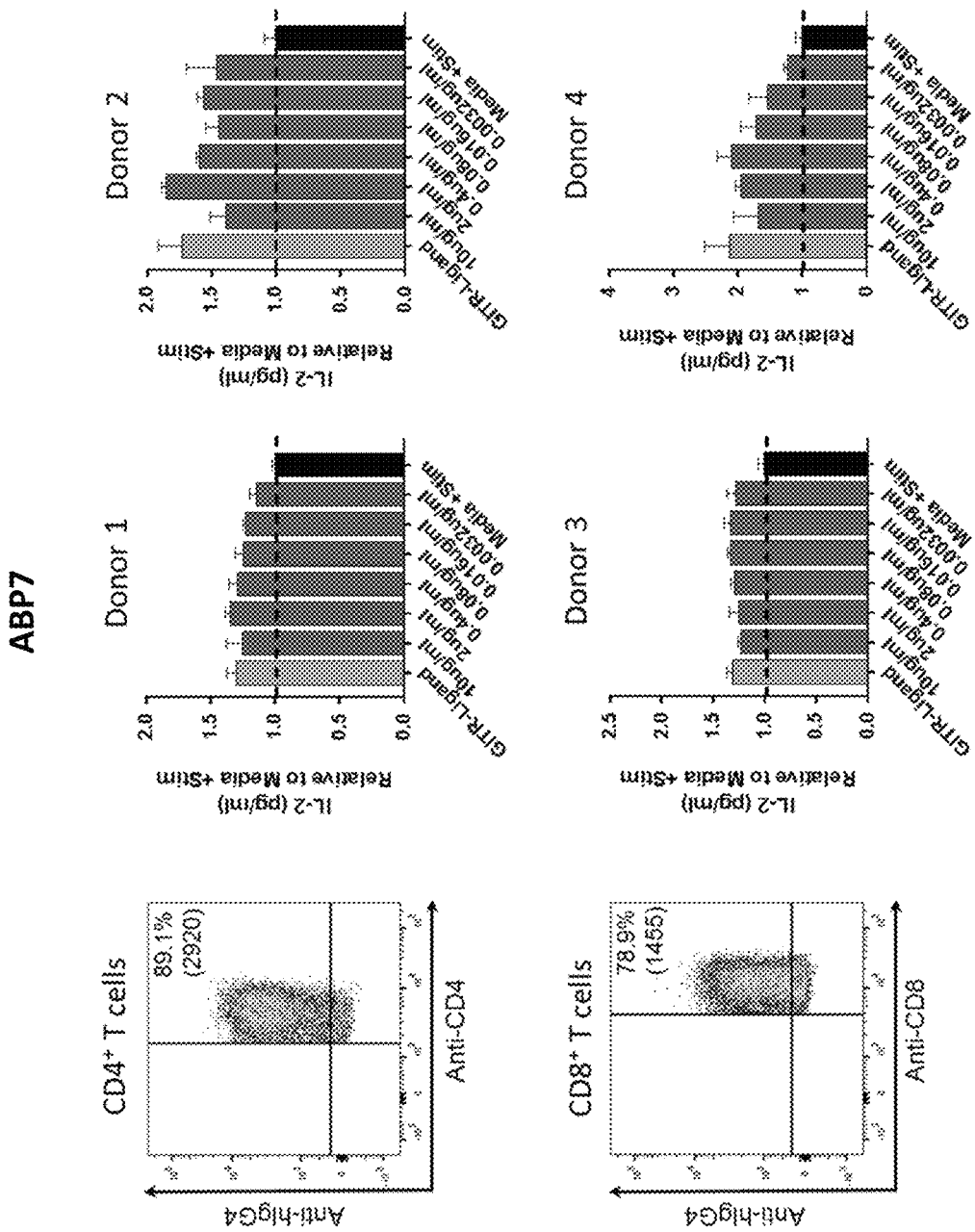

FIG. 8L show results of treatment of T-blasts from 4 different donors treated with controls or ABPs and the resultant IL-2 production (data normalized to levels of IL-2 production achieved in control media). In the FIG. the top row, from left to right is FACS measurement of the ABP binding to CD4+ cells, IL-2 production in cells from Donor 1, IL-2 production in cells from Donor 2. In the bottom row, from left to right, is FACS measurement of the ABP binding to CD8+ cells, IL-2 production in cells from Donor 3, IL-2 production in cells from Donor 4. Shown are data as follows: FIG. 8L: ABP7.

Figure 8M:
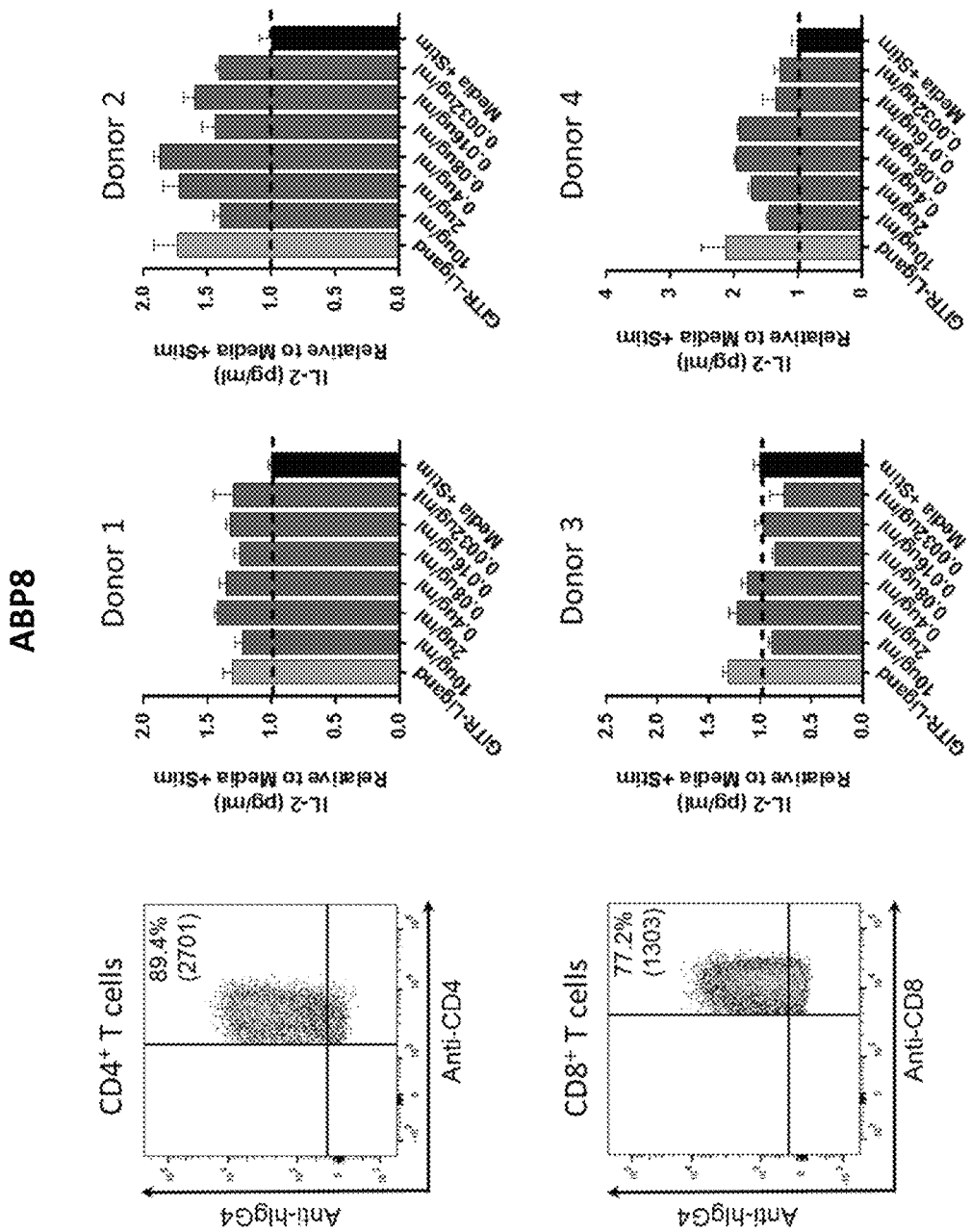

FIG. 8M show results of treatment of T-blasts from 4 different donors treated with controls or ABPs and the resultant IL-2 production (data normalized to levels of IL-2 production achieved in control media). In the FIG. the top row, from left to right is FACS measurement of the ABP binding to CD4+ cells, IL-2 production in cells from Donor 1, IL-2 production in cells from Donor 2. In the bottom row, from left to right, is FACS measurement of the ABP binding to CD8+ cells, IL-2 production in cells from Donor 3, IL-2 production in cells from Donor 4. Shown are data as follows: FIG. 8M: ABP8.

Figure 9A:
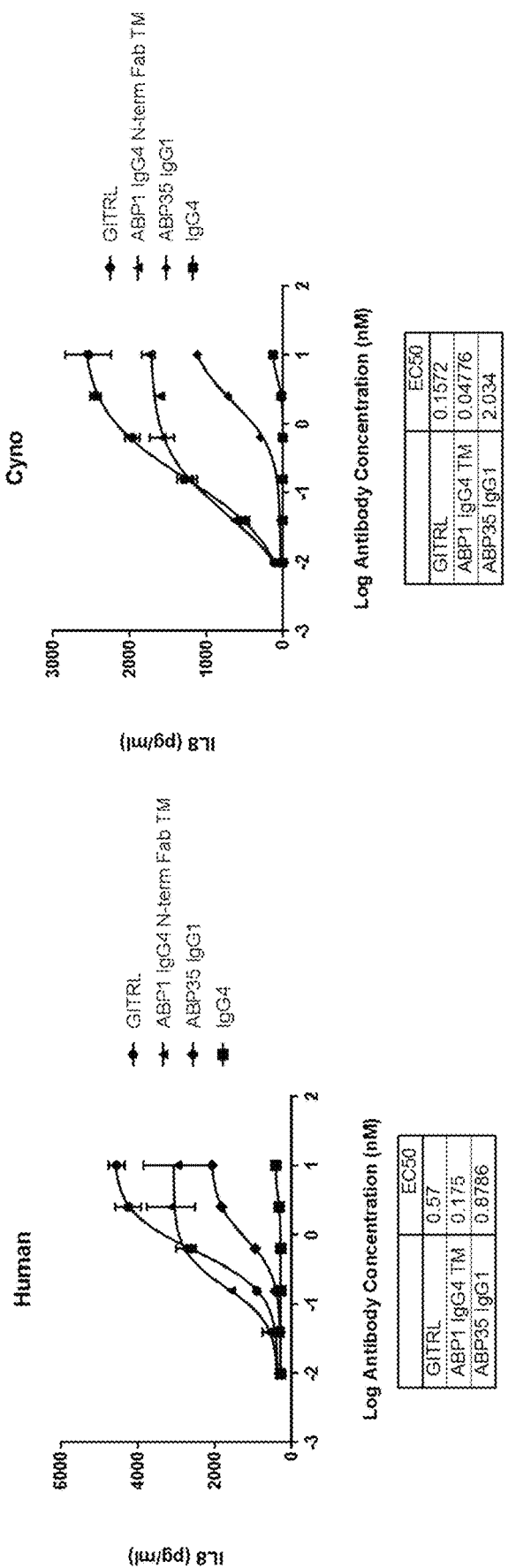

FIG. 9A is graphs showing a comparison of the activity of the optimized N-terminal Fab TM ABPs ("IgG4 TM") against the corresponding optimized non-TM IgG1 N297A ABPs ("IgG1"). HT1080 cells that stably express human (left panel) or cynomolgus (right panel) were then treated with each N-terminal Fab TM ABP and corresponding IgG1 ABP as follows: ABP1 IgG4 TM/ABP35 IgG1 (FIG. 9A), and IgG4 as a positive control. Induction of IL-8 by GITRL is shown as circles, by IgG4 TM format ABPs as triangles, by the corresponding IgG1 ABPs as diamonds, and by IgG4 control antibodies as squares. A table of $EC_{50}$ values is shown on the bottom of each panel.

Figure 9B:
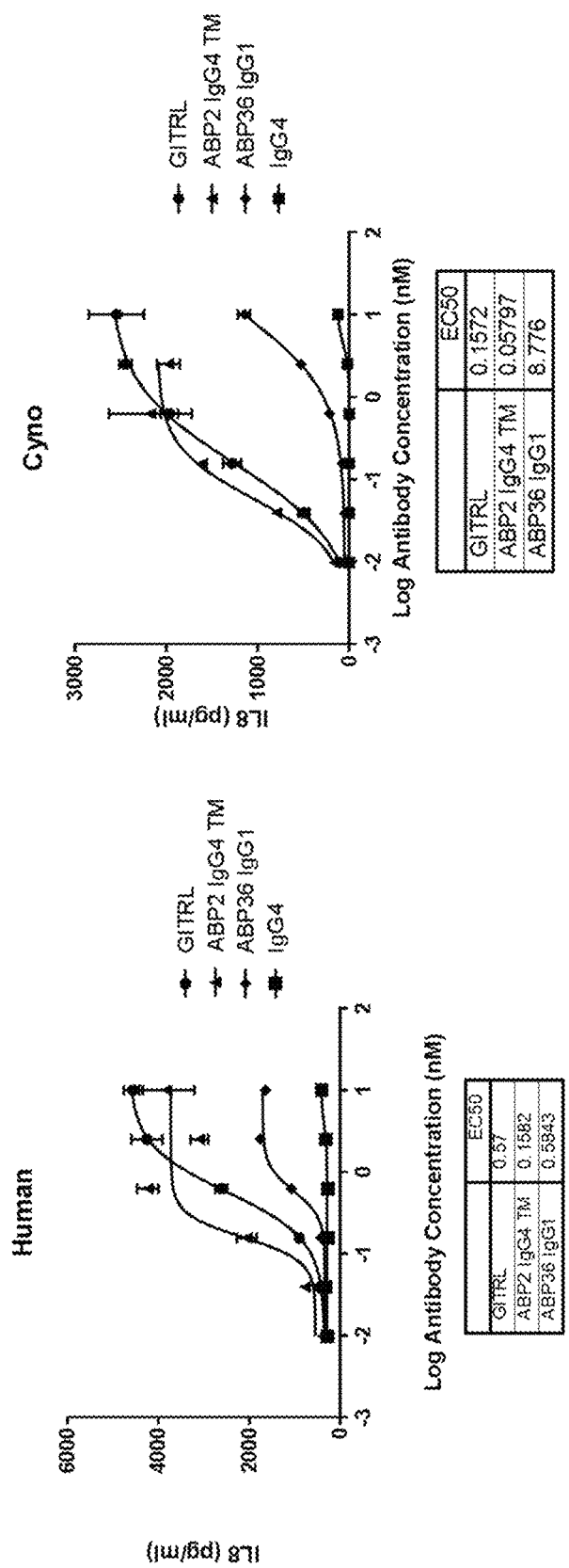

FIG. 9B is graphs showing a comparison of the activity of the optimized N-terminal Fab TM ABPs ("IgG4 TM") against the corresponding optimized non-TM IgG1 N297A ABPs ("IgG1"). HT1080 cells that stably express human (left panel) or cynomolgus (right panel) were then treated with each N-terminal Fab TM ABP and corresponding IgG1 ABP as follows: ABP2 IgG4 TM/ABP36 IgG1 (FIG. 9B), and IgG4 as a positive control. Induction of IL-8 by GITRL is shown as circles, by IgG4 TM format ABPs as triangles, by the corresponding IgG1 ABPs as diamonds, and by IgG4 control antibodies as squares. A table of $EC_{50}$ values is shown on the bottom of each panel.

Figure 9C:
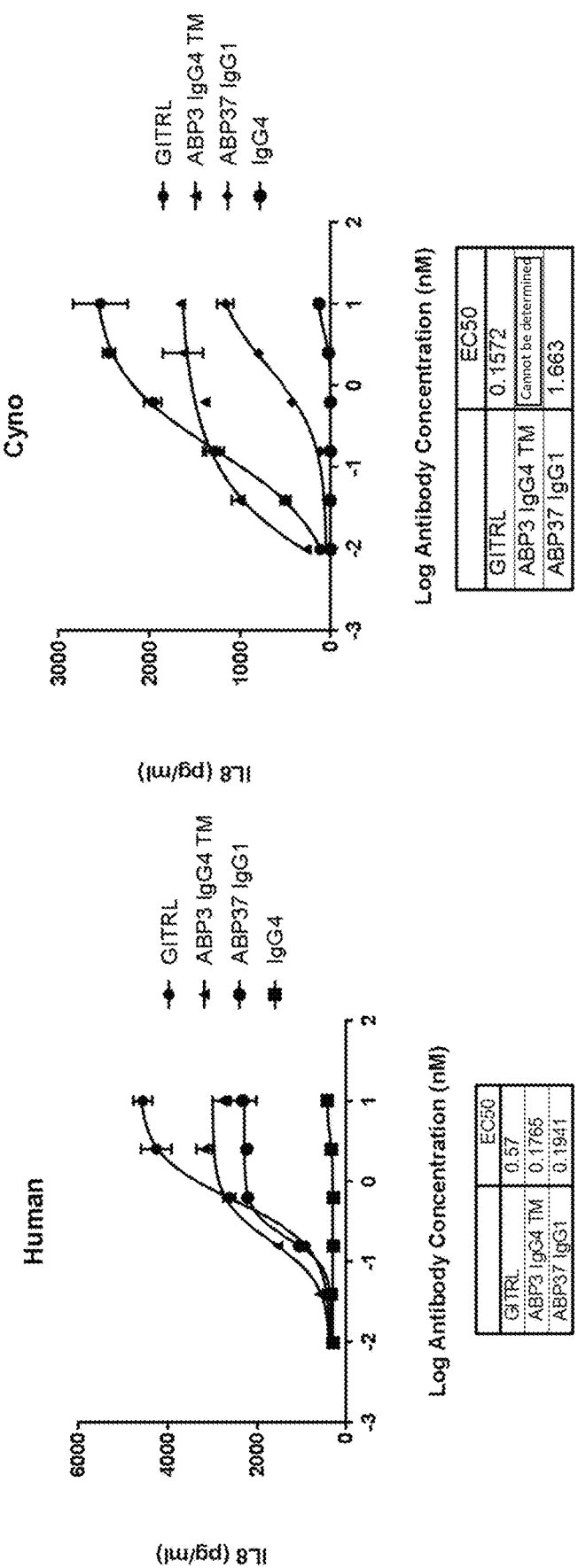

FIG. 9C is graphs showing a comparison of the activity of the optimized N-terminal Fab TM ABPs ("IgG4 TM") against the corresponding optimized non-TM IgG1 N297A ABPs ("IgG1"). HT1080 cells that stably express human (left panel) or cynomolgus (right panel) were then treated with each N-terminal Fab TM ABP and corresponding IgG1 ABP as follows: ABP3 IgG4 TM/ABP37 IgG1 (FIG. 9C), and IgG4 as a positive control. Induction of IL-8 by GITRL is shown as circles, by IgG4 TM format ABPs as triangles, by the corresponding IgG1 ABPs as diamonds, and by IgG4 control antibodies as squares. A table of $EC_{50}$ values is shown on the bottom of each panel.

Figure 9D:
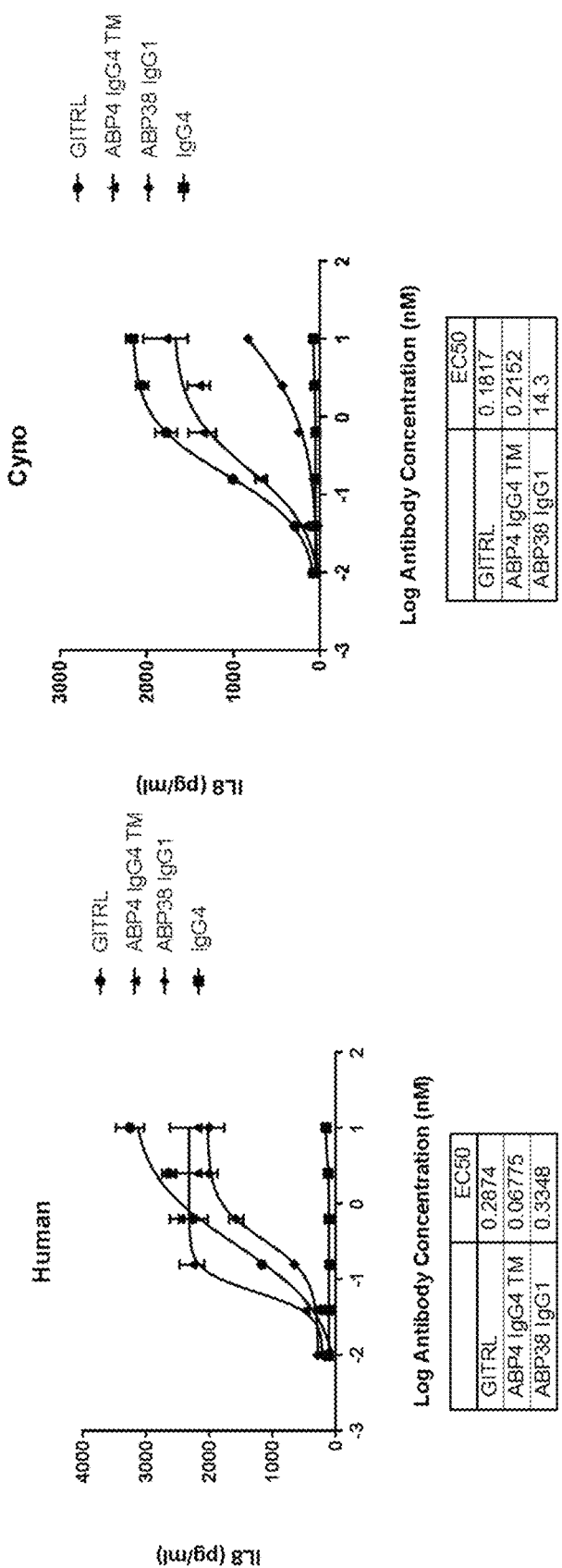

FIG. 9D is graphs showing a comparison of the activity of the optimized N-terminal Fab TM ABPs ("IgG4 TM") against the corresponding optimized non-TM IgG1 N297A ABPs ("IgG1"). HT1080 cells that stably express human (left panel) or cynomolgus (right panel) were then treated with each N-terminal Fab TM ABP and corresponding IgG1 ABP as follows: ABP4 IgG4 TM/ABP38 IgG1 (FIG. 9D), and IgG4 as a positive control. Induction of IL-8 by GITRL is shown as circles, by IgG4 TM format ABPs as triangles, by the corresponding IgG1 ABPs as diamonds, and by IgG4 control antibodies as squares. A table of $EC_{50}$ values is shown on the bottom of each panel.

Figure 9E:
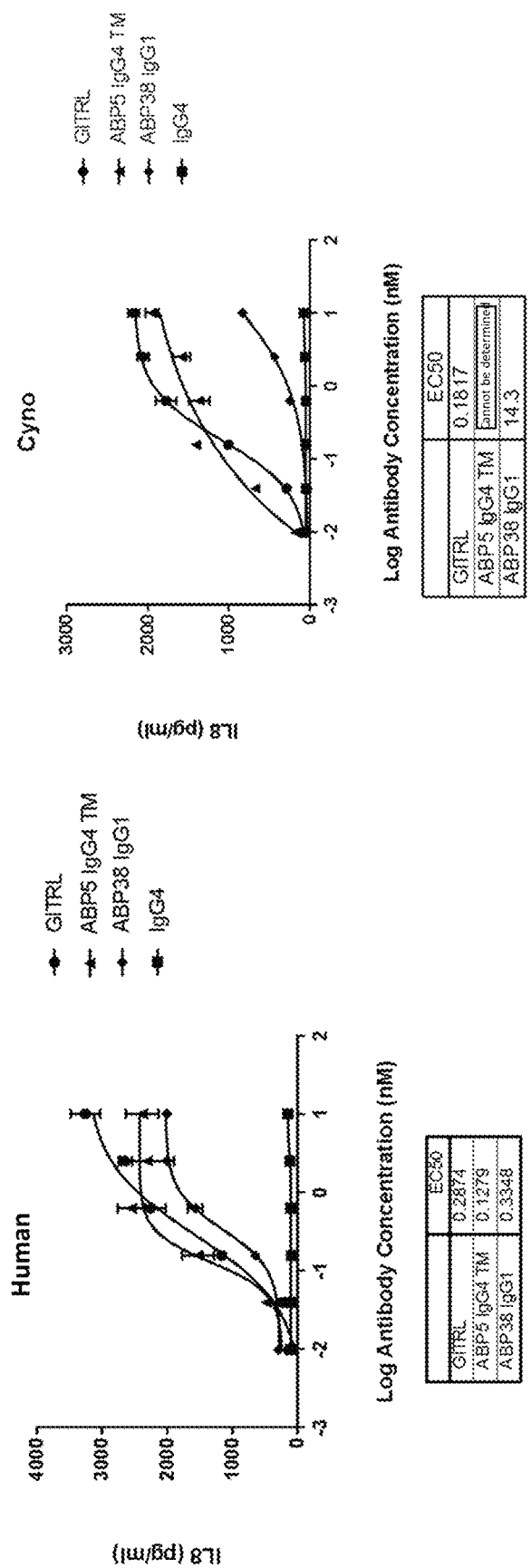

FIG. 9E is graphs showing a comparison of the activity of the optimized N-terminal Fab TM ABPs ("IgG4 TM") against the corresponding optimized non-TM IgG1 N297A ABPs ("IgG1"). HT1080 cells that stably express human (left panel) or cynomolgus (right panel) were then treated with each N-terminal Fab TM ABP and corresponding IgG1 ABP as follows: ABP5 IgG4 TM/ABP38 P45L IgG1 (FIG. 9E), and IgG4 as a positive control. Induction of IL-8 by GITRL is shown as circles, by IgG4 TM format ABPs as triangles, by the corresponding IgG1 ABPs as diamonds, and by IgG4 control antibodies as squares. A table of $EC_{50}$ values is shown on the bottom of each panel.

Figure 9F:
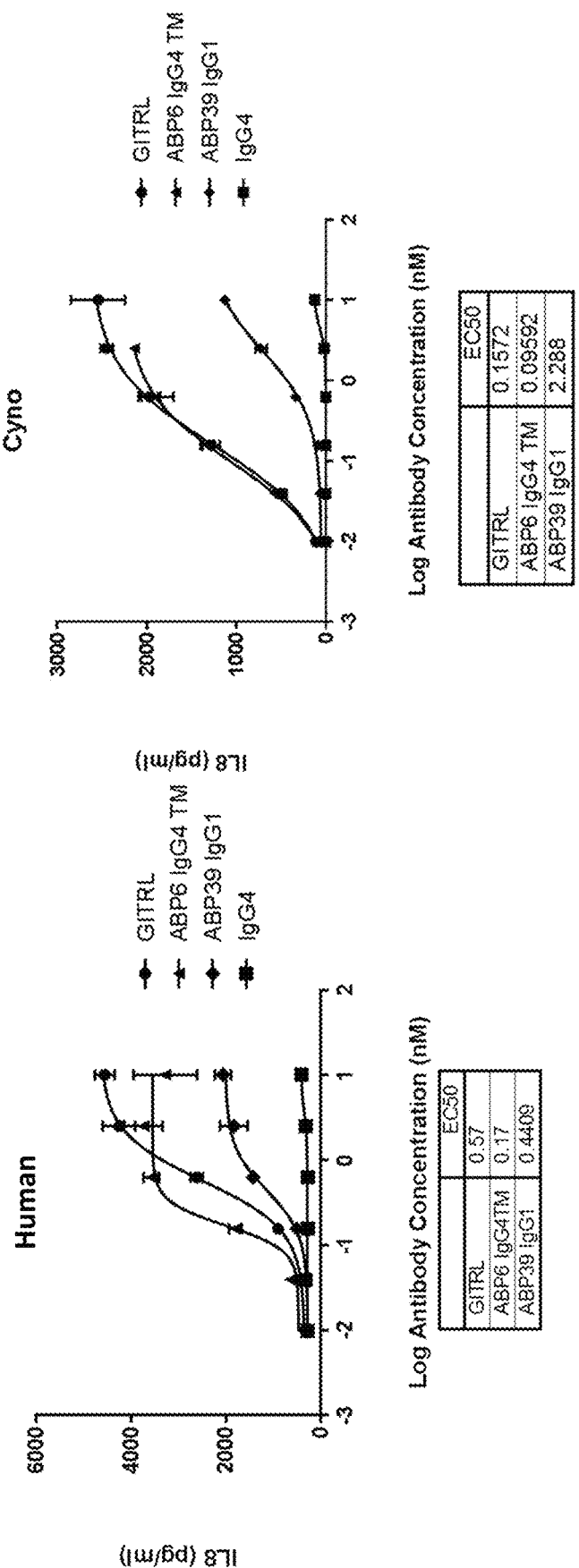

FIG. 9F is graphs showing a comparison of the activity of the optimized N-terminal Fab TM ABPs ("IgG4 TM") against the corresponding optimized non-TM IgG1 N297A ABPs ("IgG1"). HT1080 cells that stably express human (left panel) or cynomolgus (right panel) were then treated with each N-terminal Fab TM ABP and corresponding IgG1 ABP as follows: ABP6 IgG4 TM/ABP39 IgG1 (FIG. 9F), and IgG4 as a positive control. Induction of IL-8 by GITRL is shown as circles, by IgG4 TM format ABPs as triangles, by the corresponding IgG1 ABPs as diamonds, and by IgG4 control antibodies as squares. A table of $EC_{50}$ values is shown on the bottom of each panel.

Figure 9G:
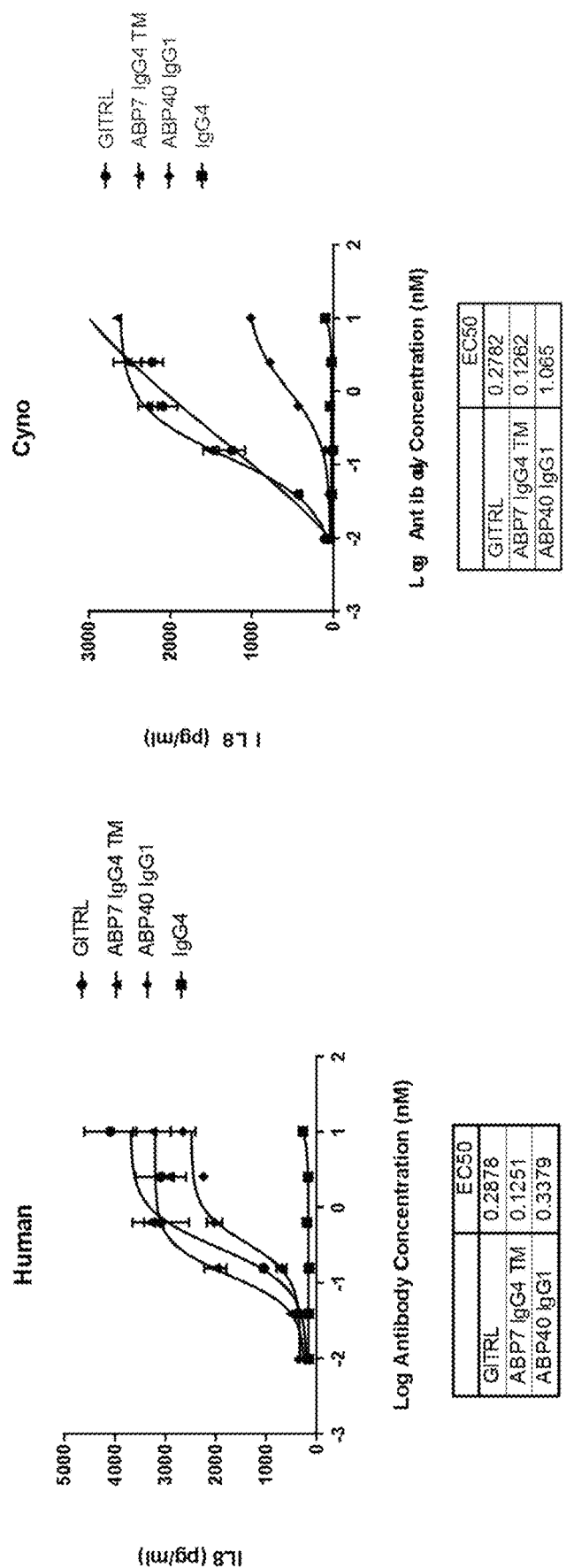

FIG. 9G is graphs showing a comparison of the activity of the optimized N-terminal Fab TM ABPs ("IgG4 TM") against the corresponding optimized non-TM IgG1 N297A ABPs ("IgG1"). HT1080 cells that stably express human (left panel) or cynomolgus (right panel) were then treated with each N-terminal Fab TM ABP and corresponding IgG1 ABP as follows: ABP7 IgG4 TM/ABP40 IgG1 (FIG. 9G) and IgG4 as a positive control. Induction of IL-8 by GITRL is shown as circles, by IgG4 TM format ABPs as triangles, by the corresponding IgG1 ABPs as diamonds, and by IgG4 control antibodies as squares. A table of $EC_{50}$ values is shown on the bottom of each panel.

Figure 9H:
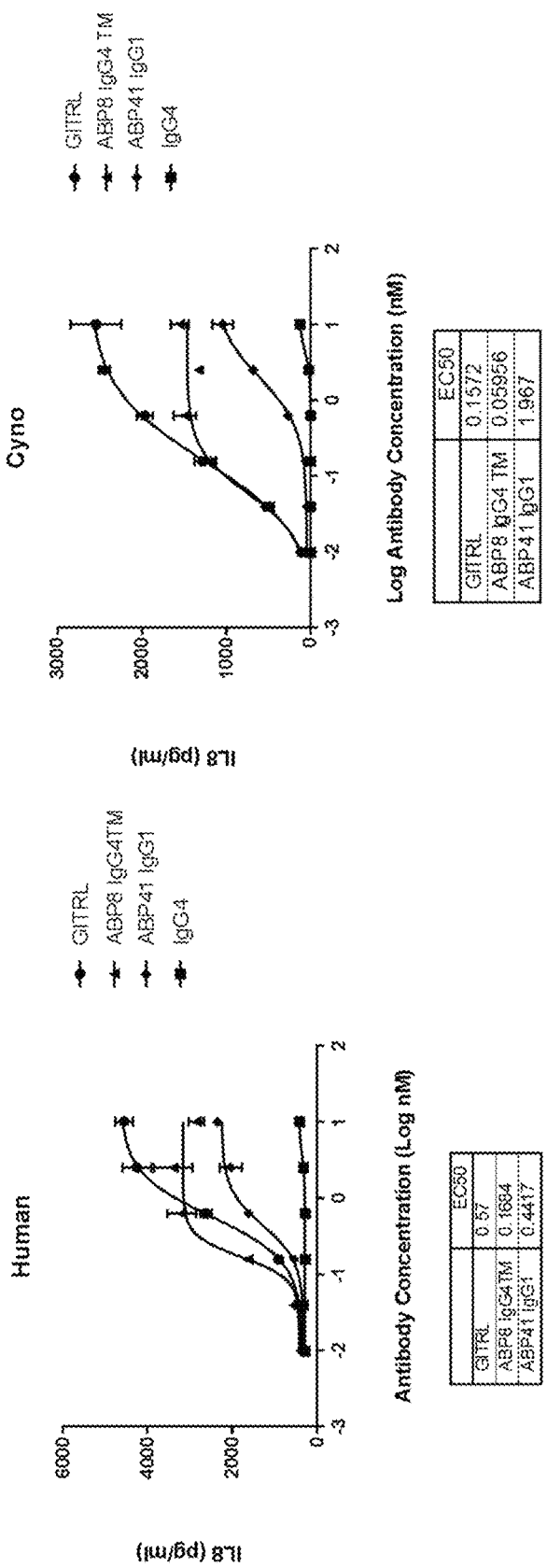

FIG. 9H is graphs showing a comparison of the activity of the optimized N-terminal Fab TM ABPs ("IgG4 TM") against the corresponding optimized non-TM IgG1 N297A ABPs ("IgG1"). HT1080 cells that stably express human (left panel) or cynomolgus (right panel) were then treated with each N-terminal Fab TM ABP and corresponding IgG1 ABP as follows: ABP8 IgG4 TM/ABP41 IgG1 (FIG. 9H) and IgG4 as a positive control. Induction of IL-8 by GITRL is shown as circles, by IgG4 TM format ABPs as triangles, by the corresponding IgG1 ABPs as diamonds, and by IgG4 control antibodies as squares. A table of $EC_{50}$ values is shown on the bottom of each panel.

Figure 10:
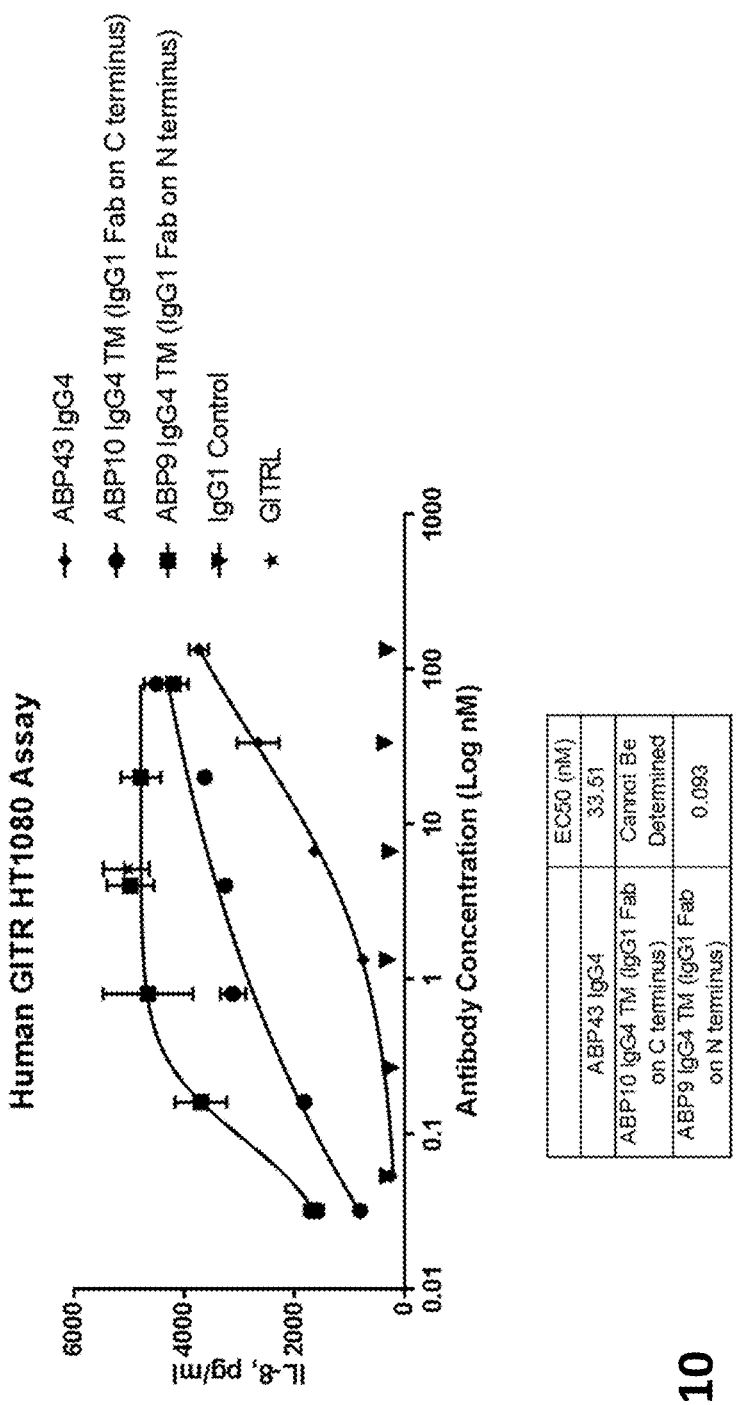

FIG. 10 is a graph showing $EC_{50}$ data in the HT1080 assay as described comparing a non-TM parental antibody with corresponding TM format versions. ABP43 (diamonds) is the non-TM IgG4 S228P parent of ABP9 (IgG4 N-terminal Fab, squares) and ABP10 (IgG4 C-terminal Fab, circles). IL-8 induction by GITRL (positive control) is shown as a single data point (star). IL-8 production is shown in pg/mL.

Figure 11A:
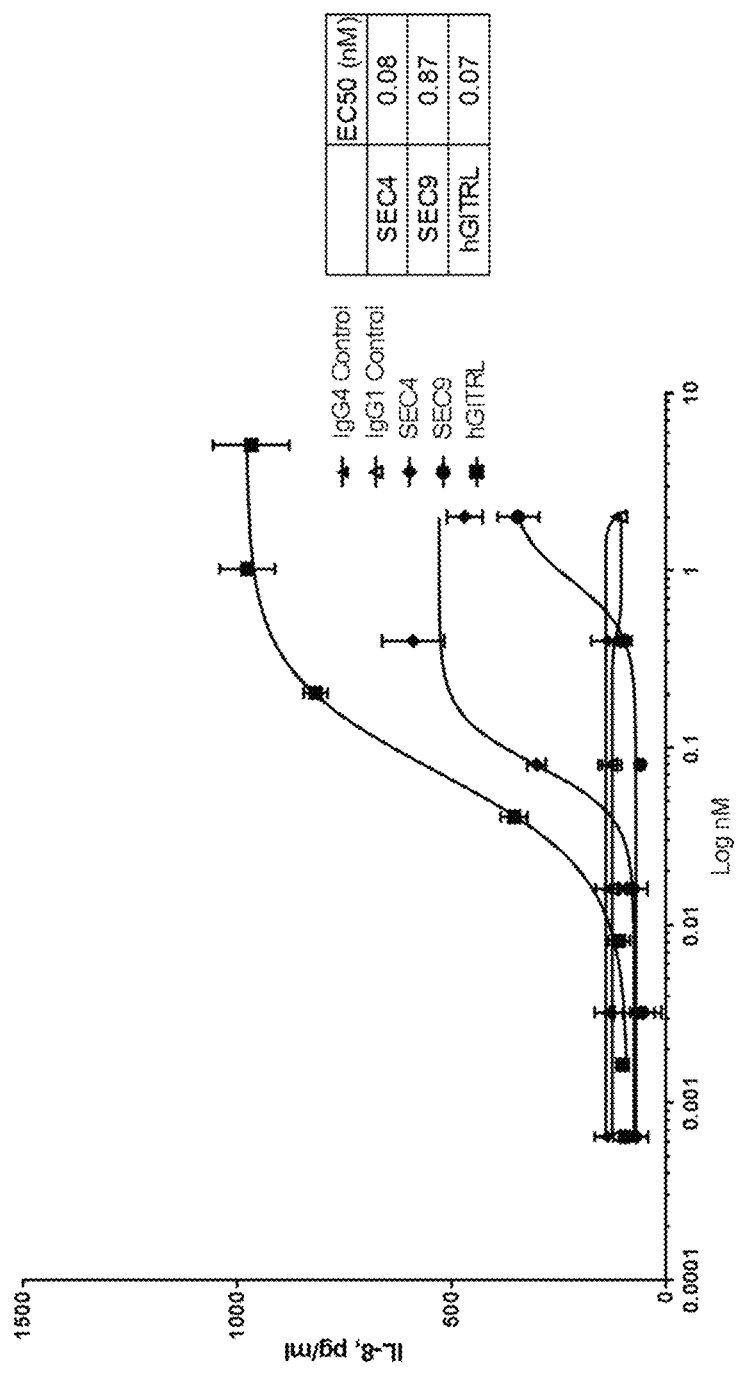

FIG. 11A is a graph showing induction of IL-8 by representative benchmark antibodies SEC4 and SEC9 in HT1080 cells that were engineered to stably express human GITR. Cultured cells were treated for six hours with a range of concentrations of two benchmark agonist antibodies SEC4 (35E6 formatted to have mouse variable regions with human IgG4 S228P/kappa regions, diamonds) and SEC9 (humanized 6C8 N62Q IgG1 N297A, circles), as well as an IgG4 negative control (closed triangles), an IgG1 negative control (open triangles), and trimeric human GITR ligand ("hGITRL", squares) as a positive control. Induction of IL-8 was measured by ELISA. As shown in the Figure, GITRL had a better $EC_{50}$ (inset) and max induction compared to both SEC4 and SEC9.

Figure 11B:
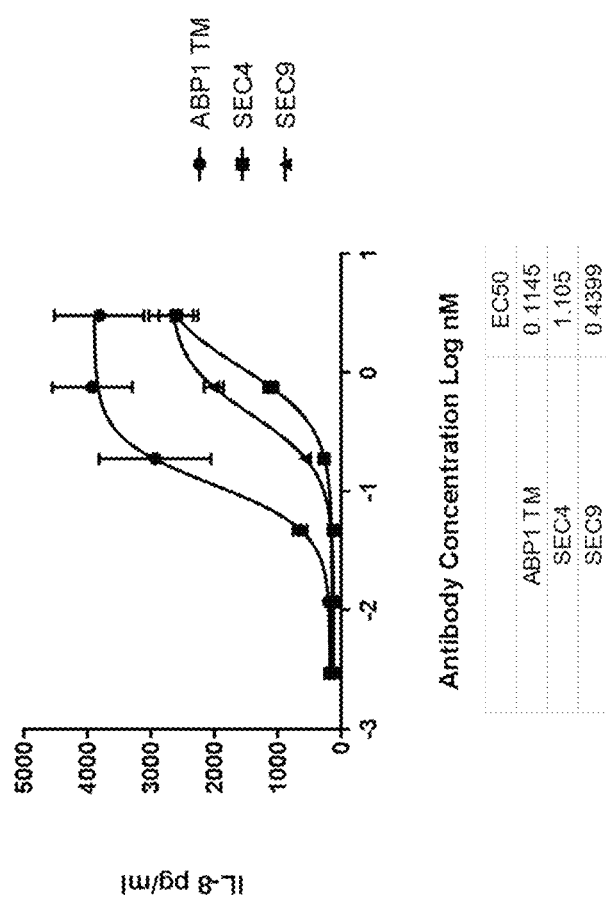

FIG. 11B shows comparison of ABP 1, with SEC4 and SEC9. TM ABPs are indicated with circles, SEC4 with squares and SEC9 with triangles. IL-8 production is shown in pg/mL.

Figure 11C:
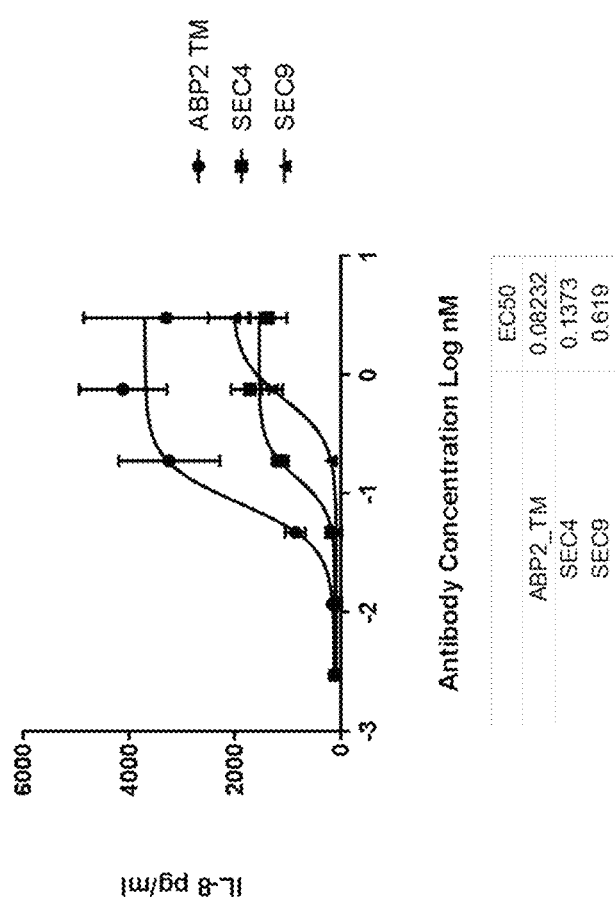

FIG. 11C shows comparison of ABP 2, with SEC4 and SEC9. TM ABPs are indicated with circles, SEC4 with squares and SEC9 with triangles. IL-8 production is shown in pg/mL.

Figure 11D:
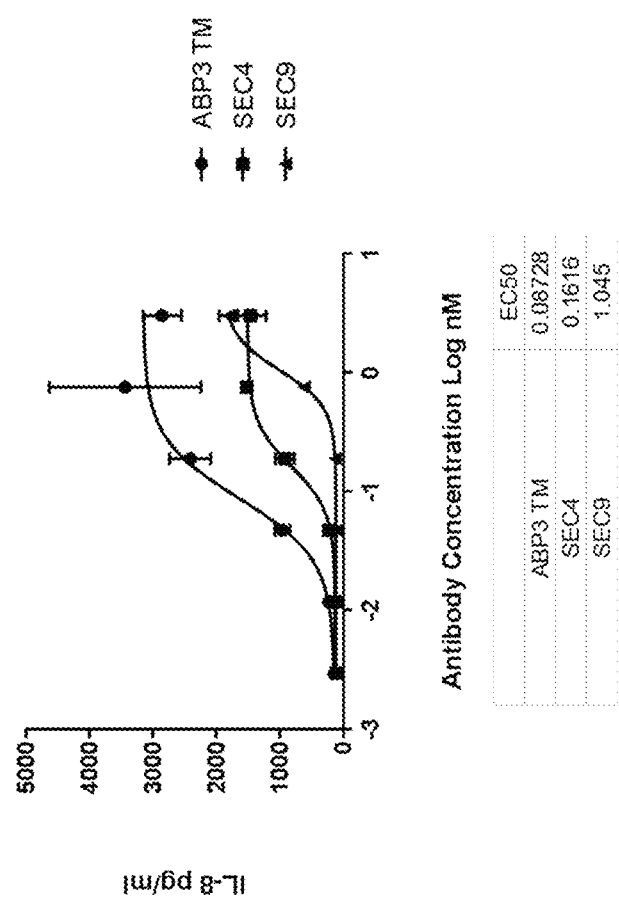

FIG. 11D shows comparison of ABP 3, with SEC4 and SEC9. TM ABPs are indicated with circles, SEC4 with squares and SEC9 with triangles. IL-8 production is shown in pg/mL.

Figure 11E:
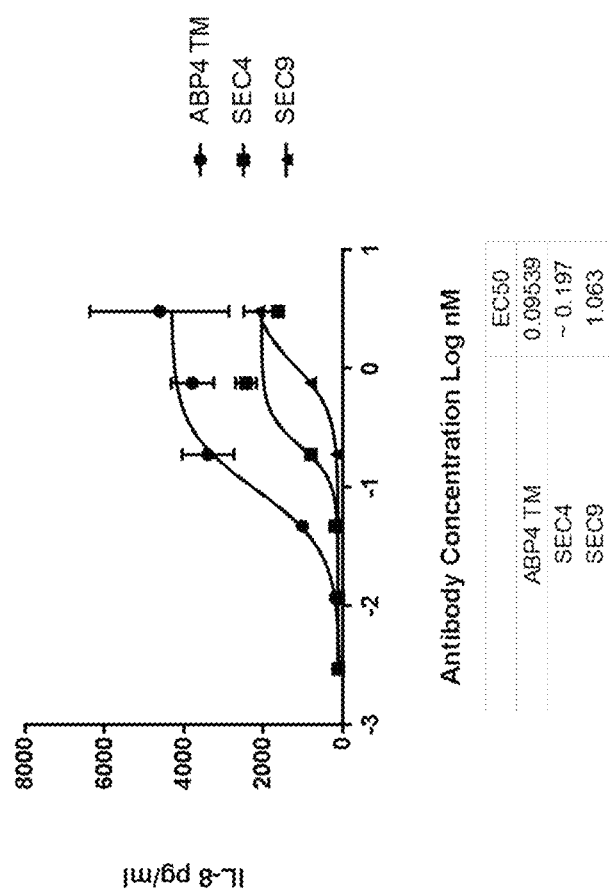

FIG. 11E shows comparison of ABP 4, with SEC4 and SEC9. TM ABPs are indicated with circles, SEC4 with squares and SEC9 with triangles. IL-8 production is shown in pg/mL.

Figure 11F:
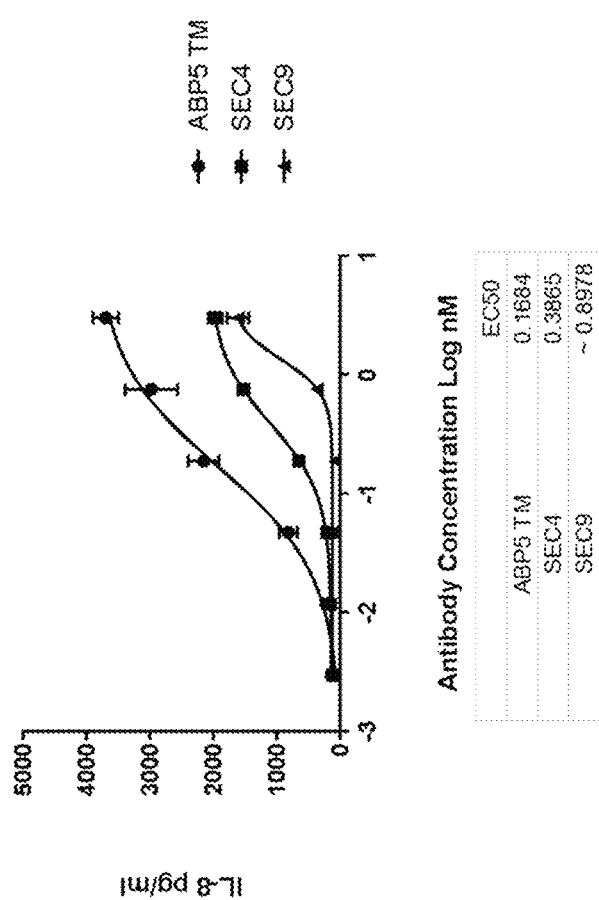

FIG. 11F shows comparison of ABP 5, with SEC4 and SEC9. TM ABPs are indicated with circles, SEC4 with squares and SEC9 with triangles. IL-8 production is shown in pg/mL.

Figure 11G:
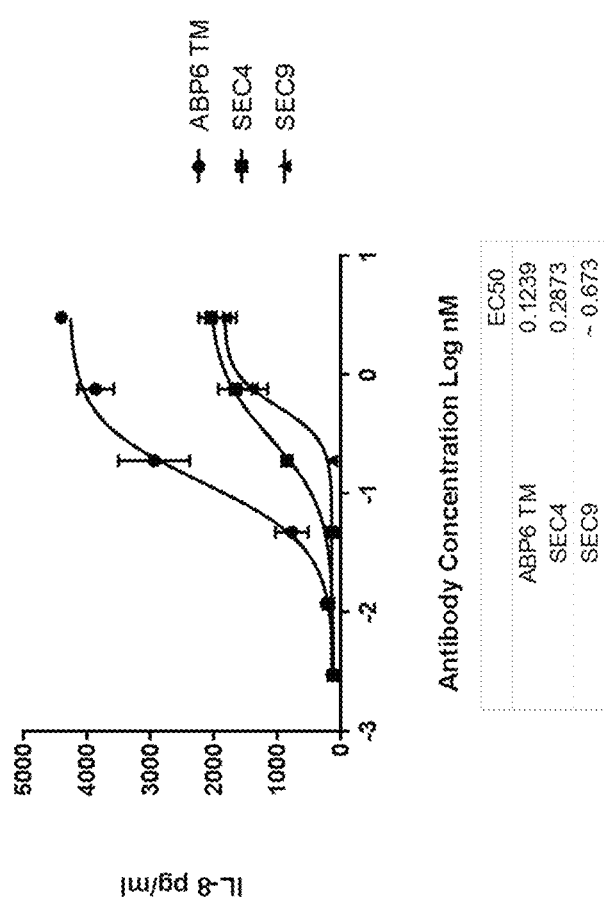

FIG. 11G shows comparison of ABP 6, with SEC4 and SEC9. TM ABPs are indicated with circles, SEC4 with squares and SEC9 with triangles. IL-8 production is shown in pg/mL.

Figure 11H:
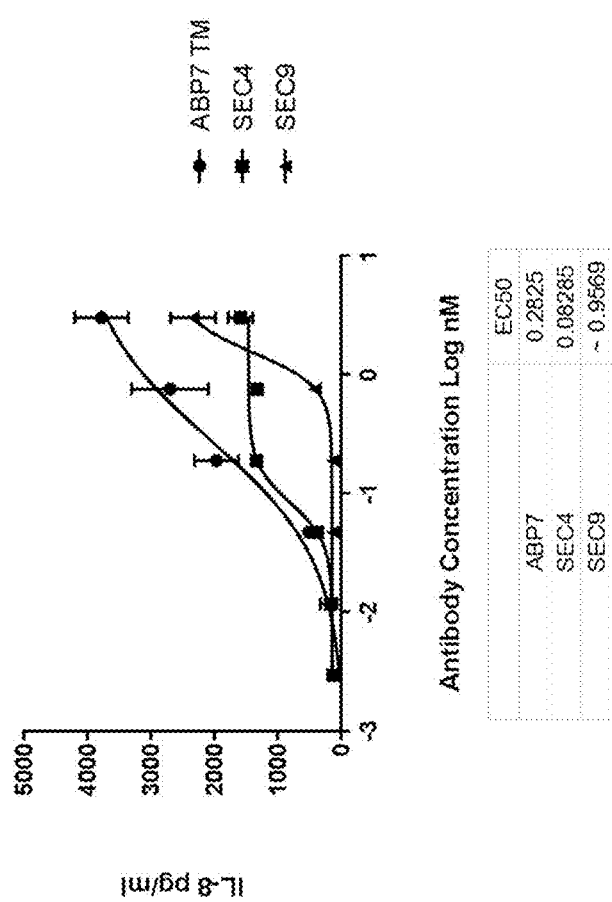

FIG. 11H shows comparison of ABP 7, with SEC4 and SEC9. TM ABPs are indicated with circles, SEC4 with squares and SEC9 with triangles. IL-8 production is shown in pg/mL.

Figure 11I:
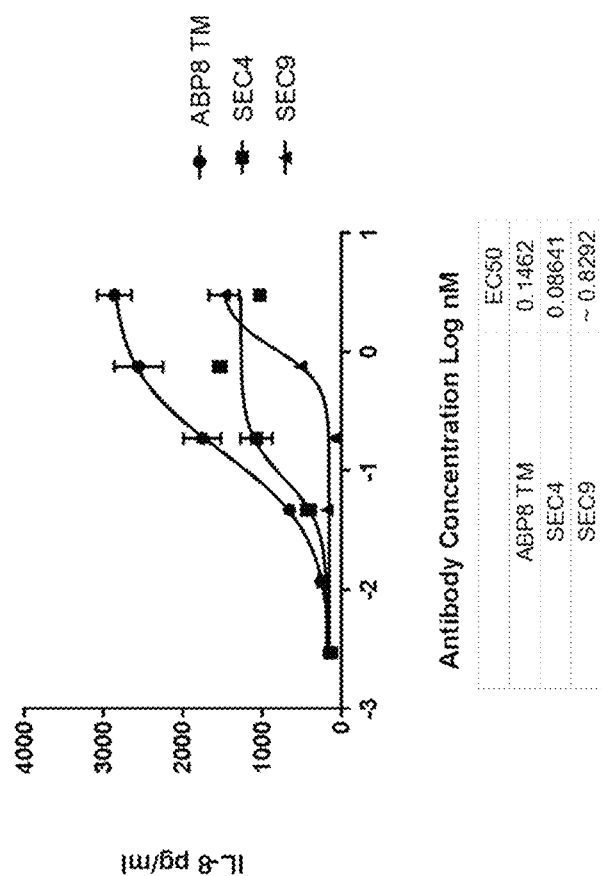

FIG. 11I shows comparison of ABP 8, with SEC4 and SEC9. TM ABPs are indicated with circles, SEC4 with squares and SEC9 with triangles. IL-8 production is shown in pg/mL.

Figure 12A:
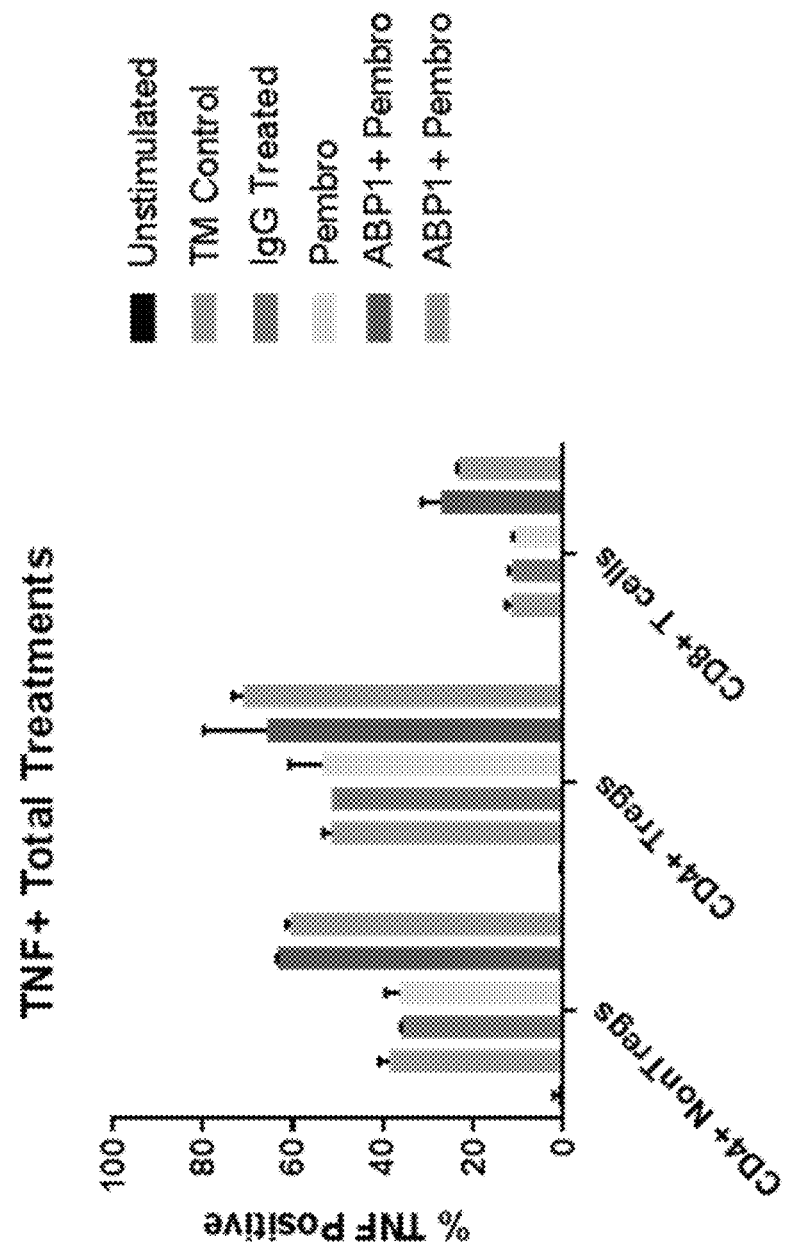

FIG. 12A is graphs showing cytokine production in stimulated isolated human NSCLC adenocarcinoma cells after treatment with TM-format ABP1 alone or in combination with pembrolizumab. Cells were either unstimulated controls, or were stimulated with 1 µg/mL αCD3 (Soluble)+2 µg/mL αCD28 (Soluble)+IL-2 (50 ng/mL); cells either received no immunotherapy treatment (for assessment of checkpoint protein levels), pembrolizumab (10 µg/mL), TM format ABP control (2 µg/mL), ABP1 (2 µg/mL), or ABP1+ pembrolizumab. Cells were incubated for 48 hours before supernatants were collected and cells were stained for checkpoint expression. In some samples, brefeldin A (an inhibitor of cytokine secretion) was added to the last five hours of stimulation for detection of cytokines by intracellular cytokine staining. Shown are TNF production (FIG. 12A).

Figure 12B:
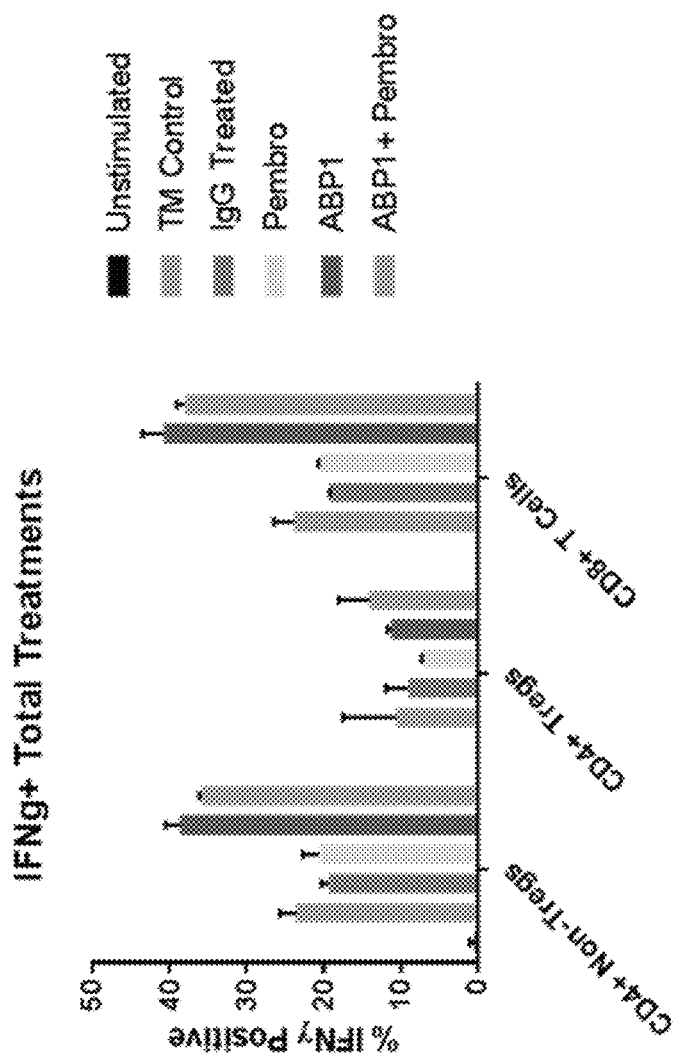

FIG. 12B is graphs showing cytokine production in stimulated isolated human NSCLC adenocarcinoma cells after treatment with TM-format ABP1 alone or in combination with pembrolizumab. Cells were either unstimulated controls, or were stimulated with 1 µg/mL αCD3 (Soluble)+2 µg/mL αCD28 (Soluble)+IL-2 (50 ng/mL); cells either received no immunotherapy treatment (for assessment of checkpoint protein levels), pembrolizumab (10 µg/mL), TM format ABP control (2 µg/mL), ABP1 (2 µg/mL), or ABP1+ pembrolizumab. Cells were incubated for 48 hours before supernatants were collected and cells were stained for checkpoint expression. In some samples, brefeldin A (an inhibitor of cytokine secretion) was added to the last five hours of stimulation for detection of cytokines by intracellular cytokine staining. Shown are IFNγ production (FIG. 12B).

Figure 13A:
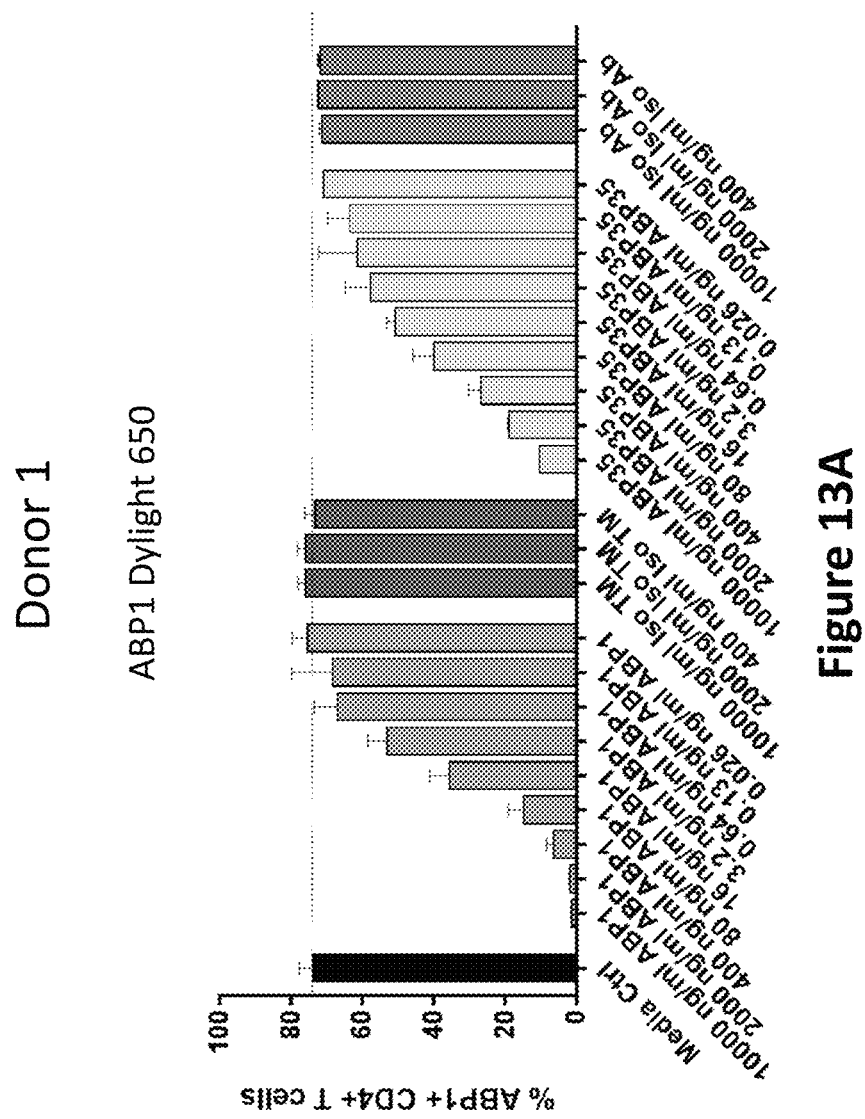

FIG. 13A is graphs showing GITR clustering and internalization after antibody binding. GITR internalization was measured in CD4+ cells (FIGS. 13A-E) and CD8+ cells (FIGS. 13F-J) from either Donor 1 (FIGS. 13A-B, 13F-G) or Donor 2 (FIGS. 13C-D, 13H-I). Cells were treated with either ABP1 TM format antibody or ABP35 standard bivalent antibody. As can be observed, incubation with either ABP1 or ABP35 inhibits the subsequent staining with ABP1Dylight650 (FIGS. 13A, 13C, 13F, 13H) but only incubation with ABP1 induces GITR internalization as measured by staining with non-competitive clone 108-17 (FIGS. 13B, 13D, 13G, 13I). A determination of the $EC_{50}$ of ABP1 on cells from both donors is shown in FIG. 13E (CD4+ cells) and FIG. 13J (CD8+ cells).

Figure 13B:
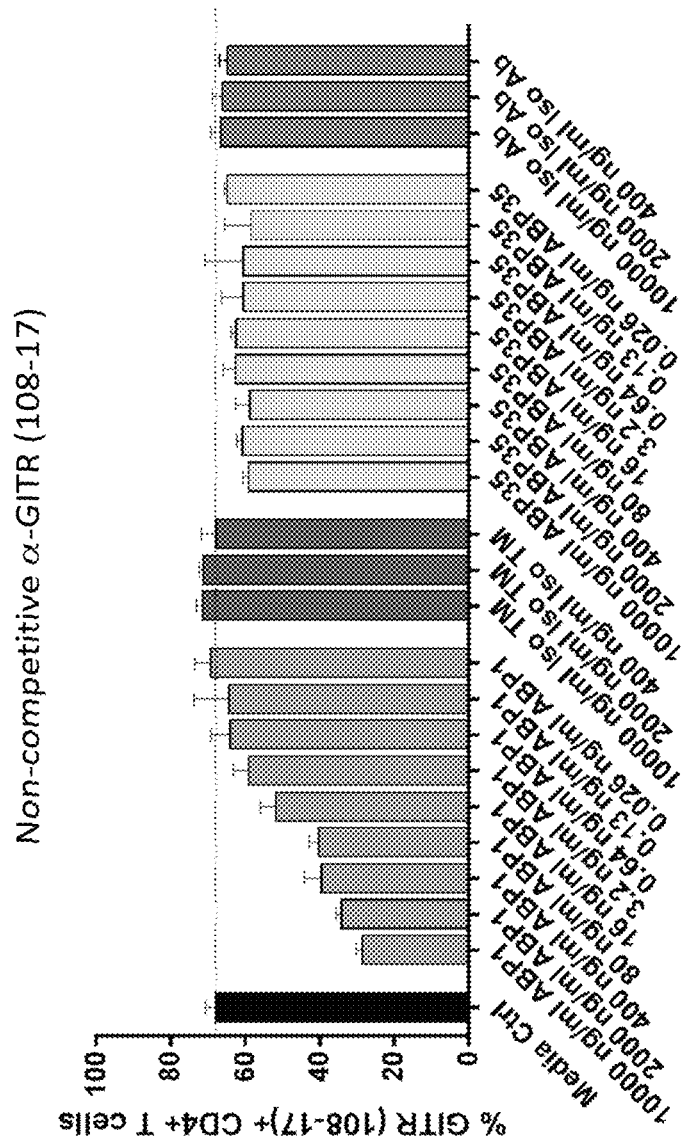

FIG. 13B is graphs showing GITR clustering and internalization after antibody binding. GITR internalization was measured in CD4+ cells (FIGS. 13A-E) and CD8+ cells (FIGS. 13F-J) from either Donor 1 (FIGS. 13A-B, 13F-G) or Donor 2 (FIGS. 13C-D, 13H-I). Cells were treated with either ABP1 TM format antibody or ABP35 standard bivalent antibody. As can be observed, incubation with either ABP1 or ABP35 inhibits the subsequent staining with ABP1Dylight650 (FIGS. 13A, 13C, 13F, 13H) but only incubation with ABP1 induces GITR internalization as measured by staining with non-competitive clone 108-17 (FIGS. 13B, 13D, 13G, 13I). A determination of the $EC_{50}$ of ABP1 on cells from both donors is shown in FIG. 13E (CD4+ cells) and FIG. 13J (CD8+ cells).

Figure 13C:
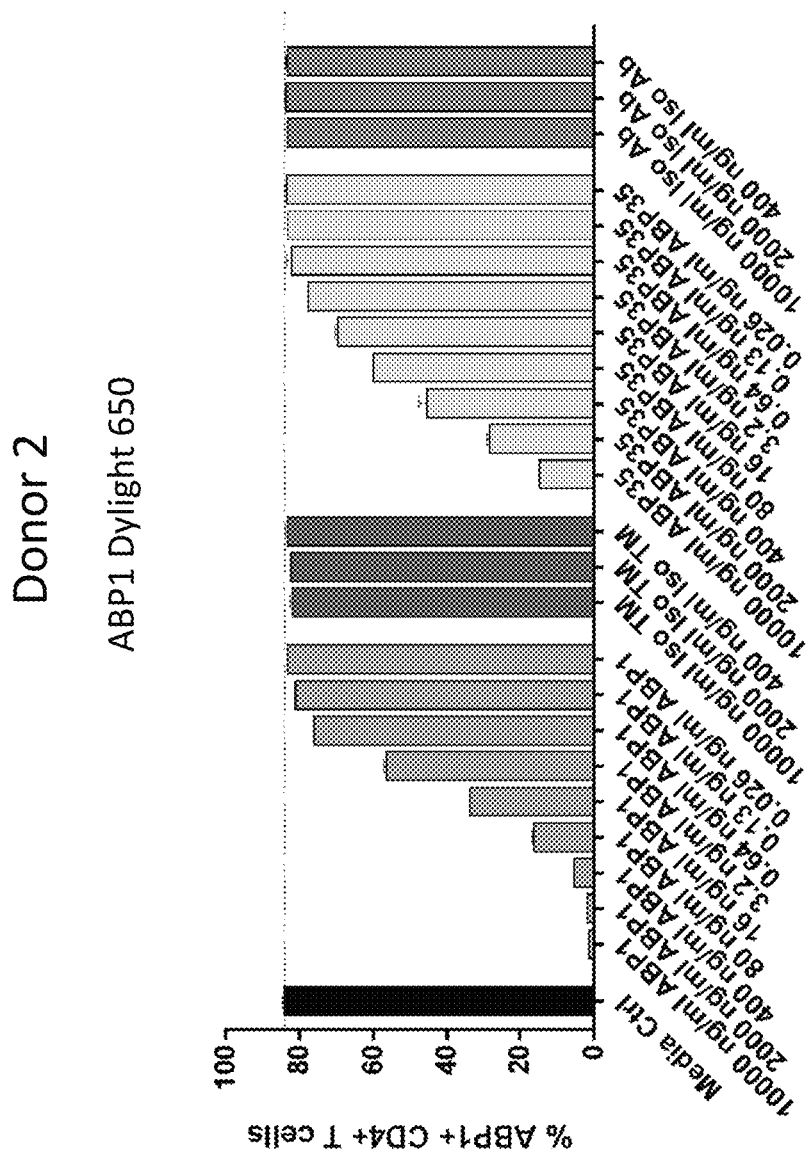

FIG. 13C is graphs showing GITR clustering and internalization after antibody binding. GITR internalization was measured in CD4+ cells (FIGS. 13A-E) and CD8+ cells (FIGS. 13F-J) from either Donor 1 (FIGS. 13A-B, 13F-G) or Donor 2 (FIGS. 13C-D, 13H-I). Cells were treated with either ABP1 TM format antibody or ABP35 standard bivalent antibody. As can be observed, incubation with either ABP1 or ABP35 inhibits the subsequent staining with ABP1Dylight650 (FIGS. 13A, 13C, 13F, 13H) but only incubation with ABP1 induces GITR internalization as measured by staining with non-competitive clone 108-17 (FIGS. 13B, 13D, 13G, 13I). A determination of the $EC_{50}$ of ABP1 on cells from both donors is shown in FIG. 13E (CD4+ cells) and FIG. 13J (CD8+ cells).

Figure 13D:
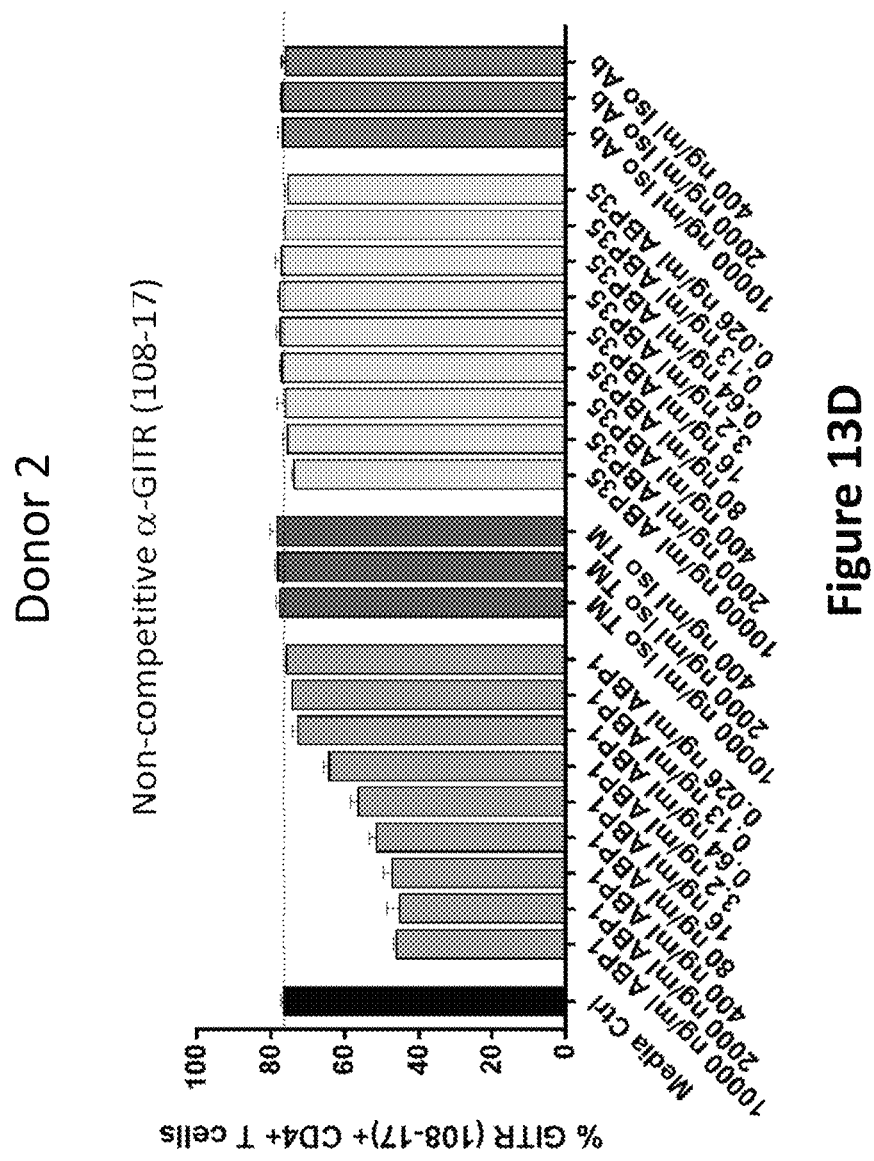
Figure 13E:
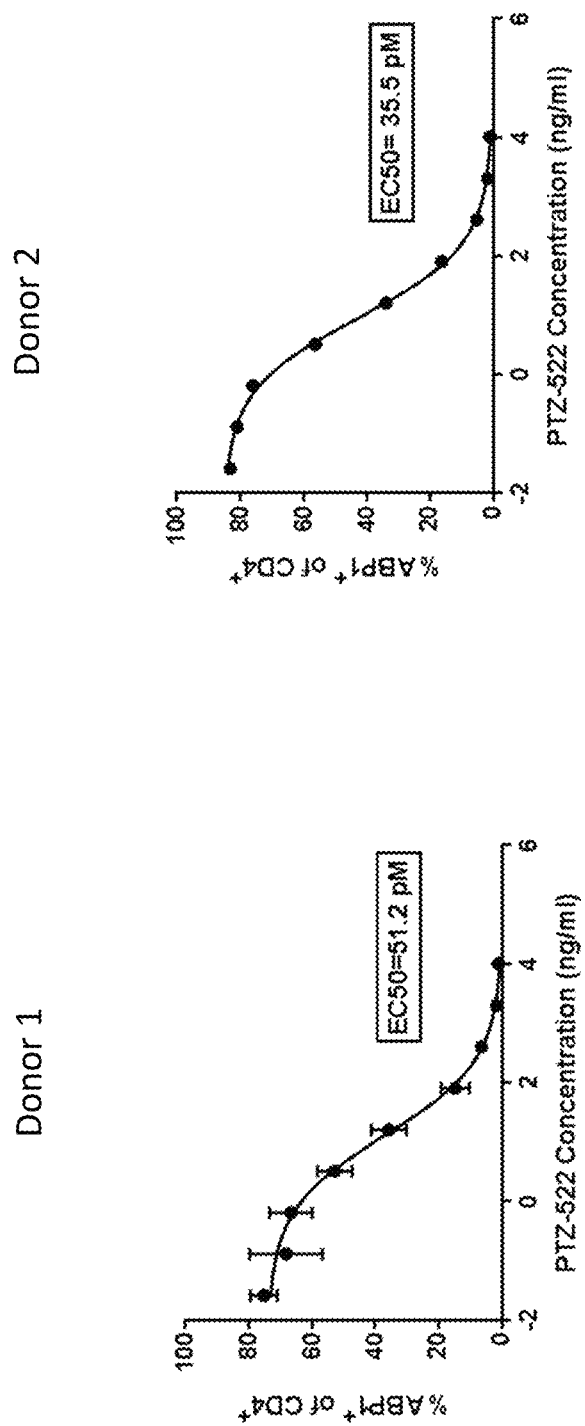

FIG. 13D is graphs showing GITR clustering and internalization after antibody binding. GITR internalization was measured in CD4+ cells (FIGS. 13A-E) and CD8+ cells (FIGS. 13F-J) from either Donor 1 (FIGS. 13A-B, 13F-G) or Donor 2 (FIGS. 13C-D, 13H-I). Cells were treated with either ABP1 TM format antibody or ABP35 standard bivalent antibody. As can be observed, incubation with either ABP1 or ABP35 inhibits the subsequent staining with ABP1Dylight650 (FIGS. 13A, 13C, 13F, 13H) but only incubation with ABP1 induces GITR internalization as measured by staining with non-competitive clone 108-17 (FIGS. 13B, 13D, 13G, 13I). A determination of the $EC_{50}$ of ABP1 on cells from both donors is shown in FIG. 13E (CD4+ cells) and FIG. 13J (CD8+ cells).

FIG. 13E is graphs showing GITR clustering and internalization after antibody binding. GITR internalization was measured in CD4+ cells (FIGS. 13A-E) and CD8+ cells (FIGS. 13F-J) from either Donor 1 (FIGS. 13A-B, 13F-G) or Donor 2 (FIGS. 13C-D, 13H-I). Cells were treated with either ABP1 TM format antibody or ABP35 standard bivalent antibody. As can be observed, incubation with either ABP1 or ABP35 inhibits the subsequent staining with ABP1Dylight650 (FIGS. 13A, 13C, 13F, 13H) but only incubation with ABP1 induces GITR internalization as measured by staining with non-competitive clone 108-17 (FIGS. 13B, 13D, 13G, 13I). A determination of the $EC_{50}$ of ABP1 on cells from both donors is shown in FIG. 13E (CD4+ cells) and FIG. 13J (CD8+ cells).

Figure 13F:
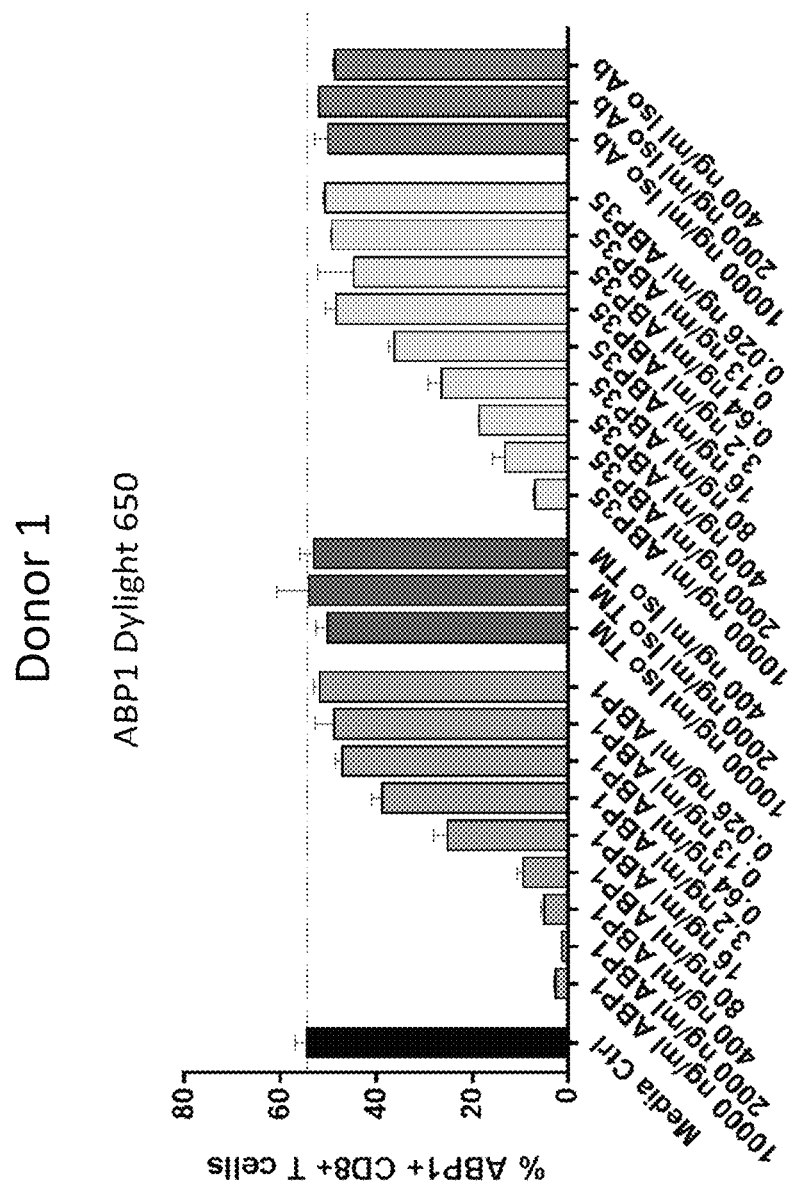

FIG. 13F is graphs showing GITR clustering and internalization after antibody binding. GITR internalization was measured in CD4+ cells (FIGS. 13A-E) and CD8+ cells (FIGS. 13F-J) from either Donor 1 (FIGS. 13A-B, 13F-G) or Donor 2 (FIGS. 13C-D, 13H-I). Cells were treated with either ABP1 TM format antibody or ABP35 standard bivalent antibody. As can be observed, incubation with either ABP1 or ABP35 inhibits the subsequent staining with ABP1Dylight650 (FIGS. 13A, 13C, 13F, 13H) but only incubation with ABP1 induces GITR internalization as measured by staining with non-competitive clone 108-17 (FIGS. 13B, 13D, 13G, 13I). A determination of the $EC_{50}$ of ABP1 on cells from both donors is shown in FIG. 13E (CD4+ cells) and FIG. 13J (CD8+ cells).

Figure 13G:
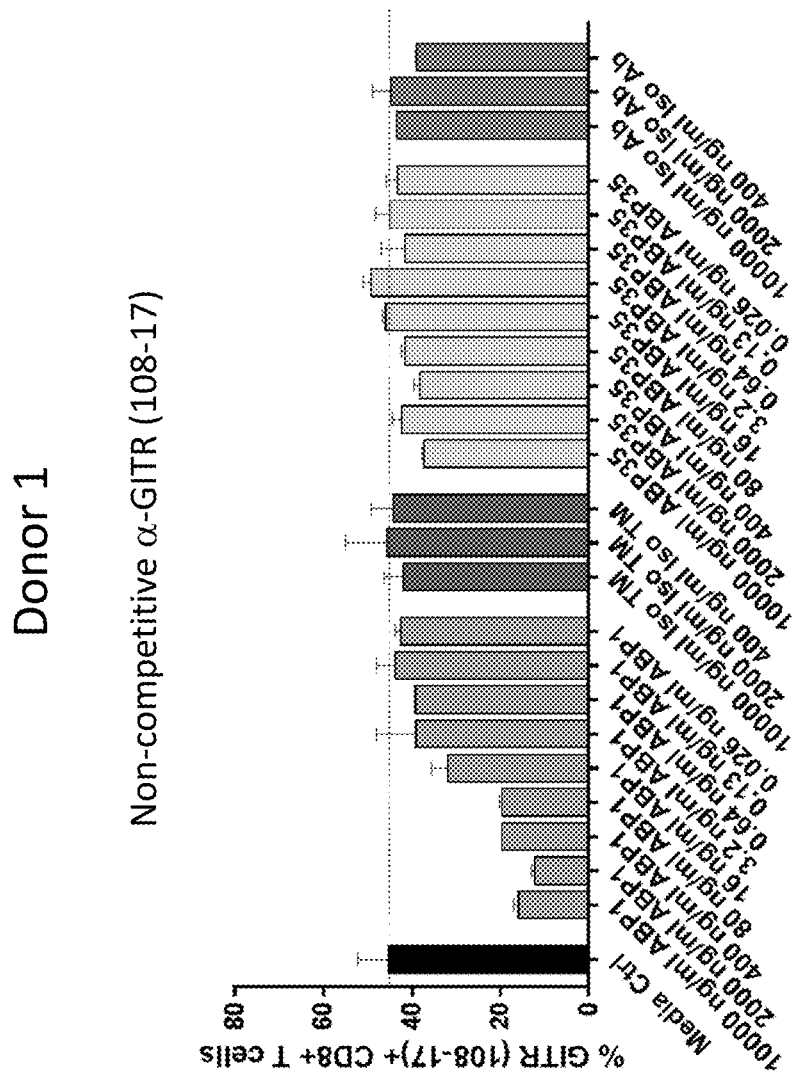

FIG. 13G is graphs showing GITR clustering and internalization after antibody binding. GITR internalization was measured in CD4+ cells (FIGS. 13A-E) and CD8+ cells (FIGS. 13F-J) from either Donor 1 (FIGS. 13A-B, 13F-G) or Donor 2 (FIGS. 13C-D, 13H-I). Cells were treated with either ABP1 TM format antibody or ABP35 standard bivalent antibody. As can be observed, incubation with either ABP1 or ABP35 inhibits the subsequent staining with ABP1Dylight650 (FIGS. 13A, 13C, 13F, 13H) but only incubation with ABP1 induces GITR internalization as measured by staining with non-competitive clone 108-17 (FIGS. 13B, 13D, 13G, 13I). A determination of the $EC_{50}$ of ABP1 on cells from both donors is shown in FIG. 13E (CD4+ cells) and FIG. 13J (CD8+ cells).

Figure 13H:
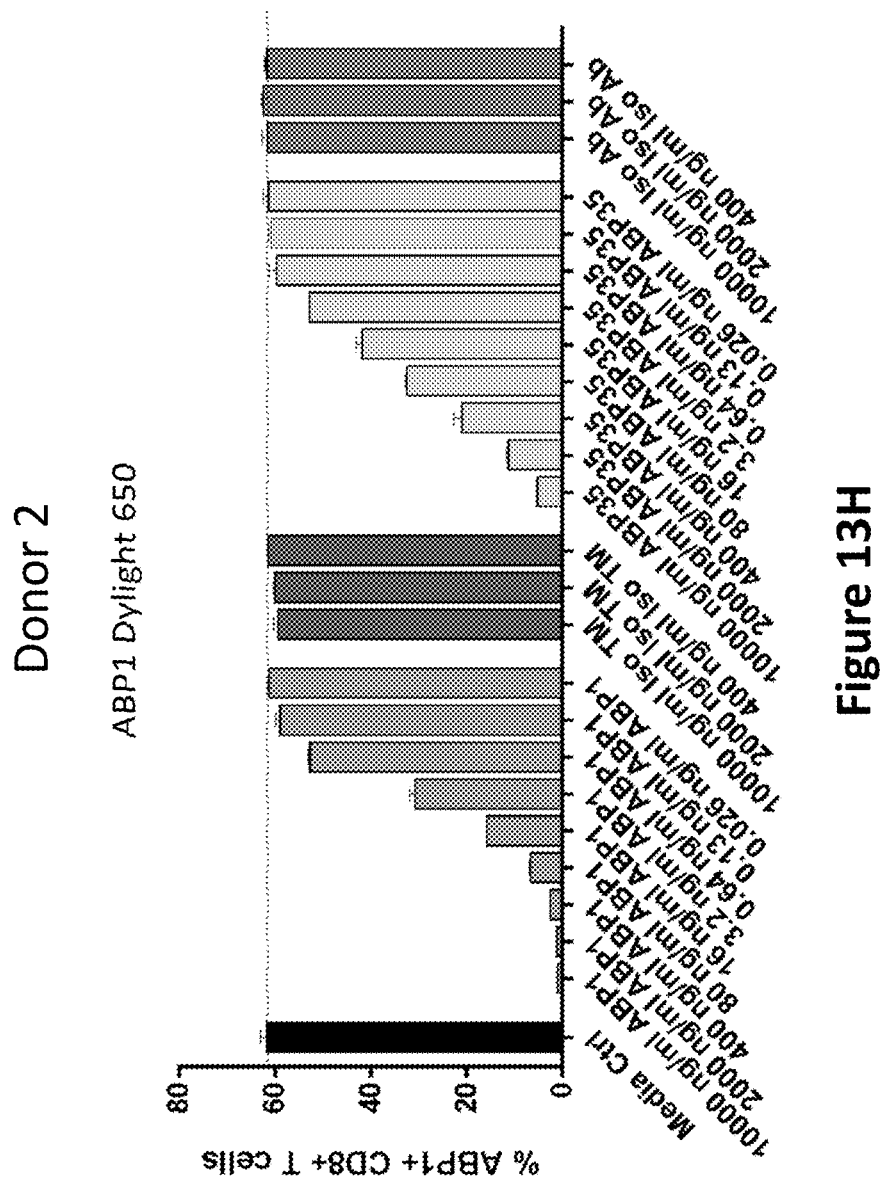

FIG. 13H is graphs showing GITR clustering and internalization after antibody binding. GITR internalization was measured in CD4+ cells (FIGS. 13A-E) and CD8+ cells (FIGS. 13F-J) from either Donor 1 (FIGS. 13A-B, 13F-G) or Donor 2 (FIGS. 13C-D, 13H-I). Cells were treated with either ABP1 TM format antibody or ABP35 standard bivalent antibody. As can be observed, incubation with either ABP1 or ABP35 inhibits the subsequent staining with ABP1Dylight650 (FIGS. 13A, 13C, 13F, 13H) but only incubation with ABP1 induces GITR internalization as measured by staining with non-competitive clone 108-17 (FIGS. 13B, 13D, 13G, 13I). A determination of the $EC_{50}$ of ABP1 on cells from both donors is shown in FIG. 13E (CD4+ cells) and FIG. 13J (CD8+ cells).

Figure 13I:
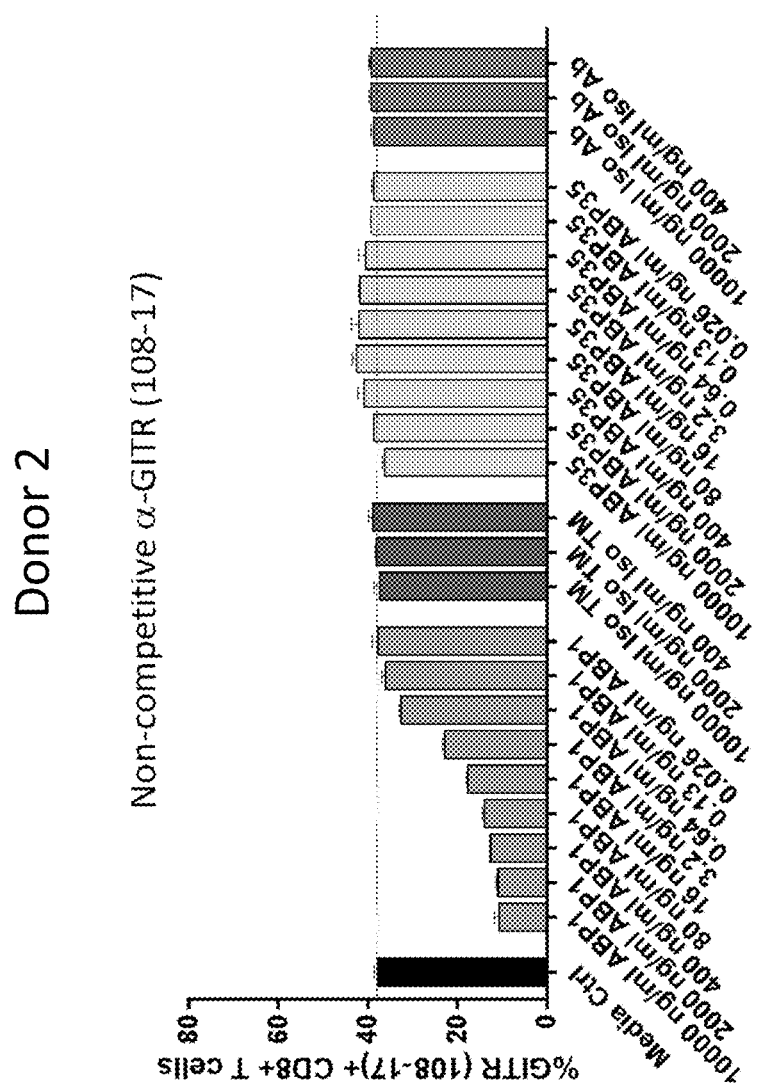

FIG. 13I is graphs showing GITR clustering and internalization after antibody binding. GITR internalization was measured in CD4+ cells (FIGS. 13A-E) and CD8+ cells (FIGS. 13F-J) from either Donor 1 (FIGS. 13A-B, 13F-G) or Donor 2 (FIGS. 13C-D, 13H-I). Cells were treated with either ABP1 TM format antibody or ABP35 standard bivalent antibody. As can be observed, incubation with either ABP1 or ABP35 inhibits the subsequent staining with ABP1Dylight650 (FIGS. 13A, 13C, 13F, 13H) but only incubation with ABP1 induces GITR internalization as measured by staining with non-competitive clone 108-17 (FIGS. 13B, 13D, 13G, 13I). A determination of the $EC_{50}$ of ABP1 on cells from both donors is shown in FIG. 13E (CD4+ cells) and FIG. 13J (CD8+ cells).

Figure 13J:
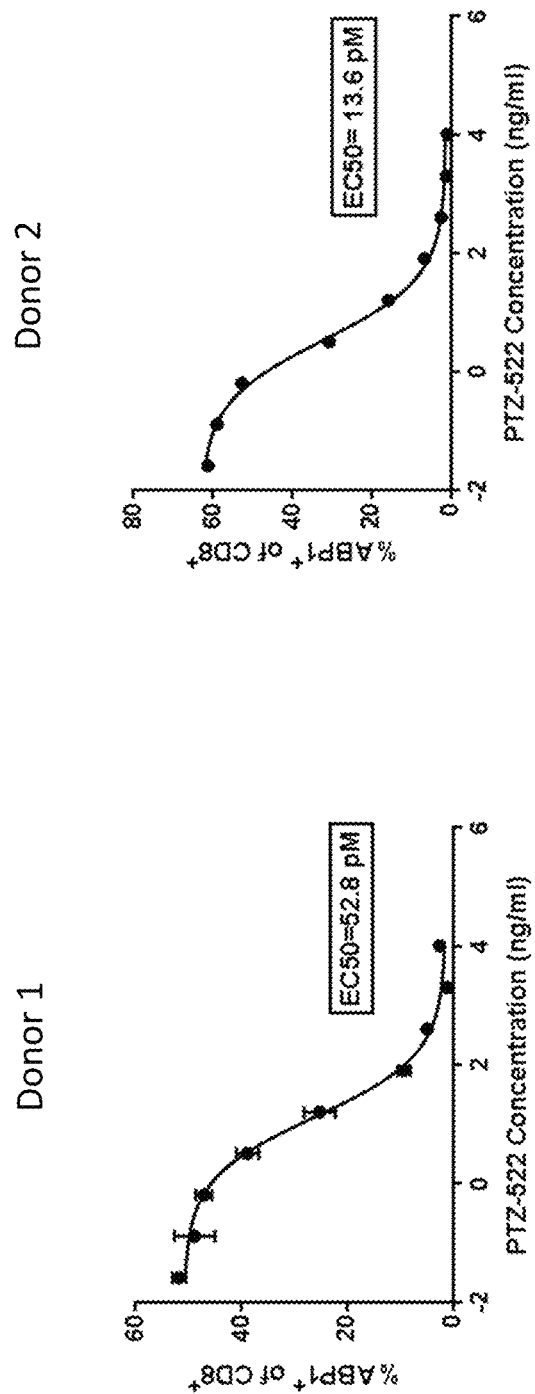

FIG. 13J is graphs showing GITR clustering and internalization after antibody binding. GITR internalization was measured in CD4+ cells (FIGS. 13A-E) and CD8+ cells (FIGS. 13F-J) from either Donor 1 (FIGS. 13A-B, 13F-G) or Donor 2 (FIGS. 13C-D, 13H-I). Cells were treated with either ABP1 TM format antibody or ABP35 standard bivalent antibody. As can be observed, incubation with either ABP1 or ABP35 inhibits the subsequent staining with ABP1Dylight650 (FIGS. 13A, 13C, 13F, 13H) but only incubation with ABP1 induces GITR internalization as measured by staining with non-competitive clone 108-17 (FIGS.

13B, 13D, 13G, 13I). A determination of the $EC_{50}$ of ABP1 on cells from both donors is shown in FIG. 13E (CD4+ cells) and FIG. 13J (CD8+ cells).

FIG. 14A shows production of cytokine (IL-2) from activated T-blasts from a healthy human donor (Donor 1, FIG. 14A) after treatment with anti-GITR IgG4 TM format antibody ABP1, its IgG1 format counterpart ABP35, and IgG4 TM format and IgG1 isotype controls. Activated CD4+/CD8+ T cells were treated with medium alone, recombinant GITR-Ligand, ABP1, hIgG4 TM Format isotype control, ABP35, or hIgG1 standard format isotype control at nine doses each: 10 µg/mL, 2 µg/mL, 0.4 µg/mL, 80 ng/mL, 16 ng/mL, 3.2 ng/mL, 0.64 ng/mL, 0.13 ng/mL, and 0.026 ng/mL. Cells were stimulated by adding 1 µg/ml anti-CD3 antibodies and 2 µg/ml anti-CD28 antibodies.

FIG. 14B shows production of cytokine (IL-2) from activated T-blasts from a healthy human donor (Donor 2, FIG. 14B) after treatment with anti-GITR IgG4 TM format antibody ABP1, its IgG1 format counterpart ABP35, and IgG4 TM format and IgG1 isotype controls. Activated CD4+/CD8+ T cells were treated with medium alone, recombinant GITR-Ligand, ABP1, hIgG4 TM Format isotype control, ABP35, or hIgG1 standard format isotype control at nine doses each: 10 µg/mL, 2 µg/mL, 0.4 µg/mL, 80 ng/mL, 16 ng/mL, 3.2 ng/mL, 0.64 ng/mL, 0.13 ng/mL, and 0.026 ng/mL. Cells were stimulated by adding 1 µg/ml anti-CD3 antibodies and 2 µg/ml anti-CD28 antibodies.

Figure 14C:
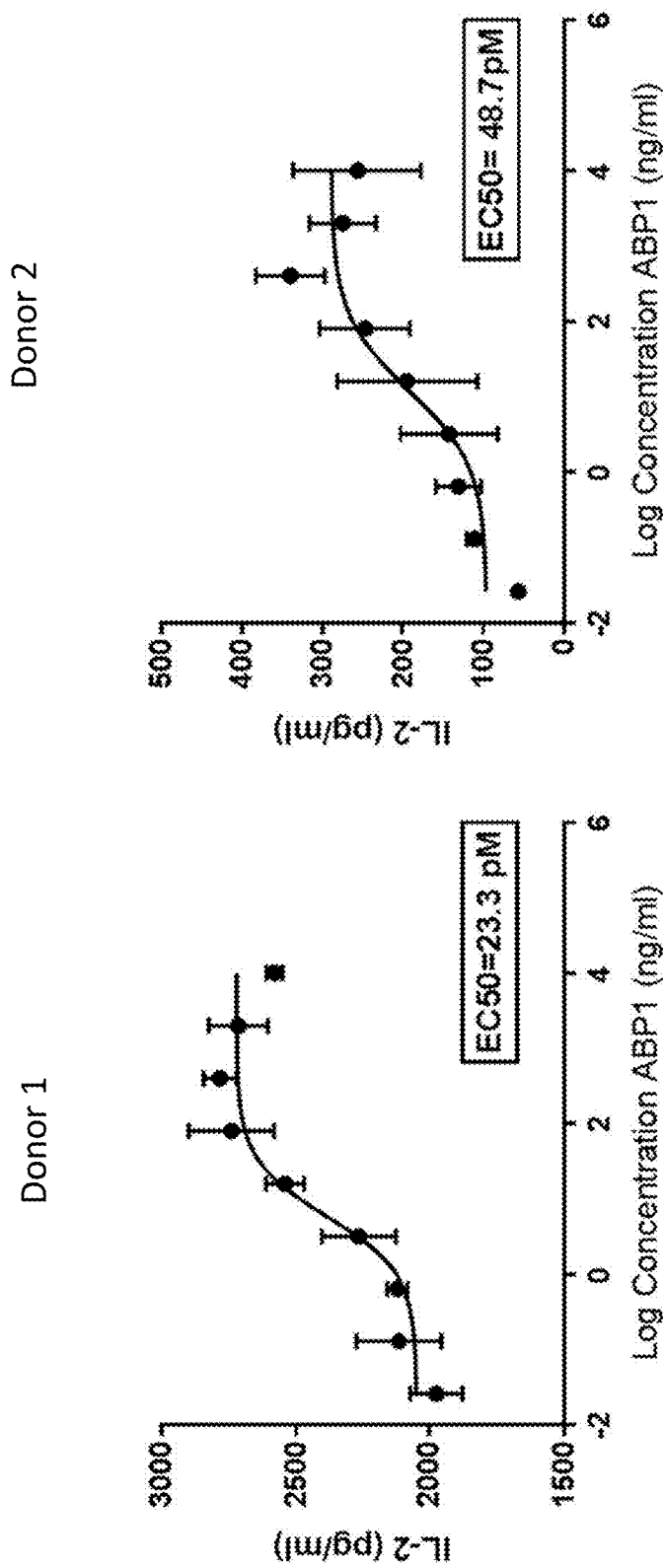

FIG. 14C shows the same data for ABP1 as in FIGS. 14A and 14B with a calculation of the $EC_{50}$ determination in each donor.

FIG. 15A shows production of cytokine (IL-2) from activated T blasts from a healthy human donor (Donor 1, FIG. 15A) after treatment with anti-GITR IgG4 TM format antibody ABP1, IgG4 TM format control ("IsoTM"), SEC4, SEC9, recombinant hGITRL and IgG1 and IgG4 isotype controls. Activated CD4+/CD8+ T cells were treated with medium alone, recombinant GITR-Ligand, ABP1, hIgG4 TM Format isotype control, SEC4, SEC9, IgG1 standard format isotype control, or hIgG1 standard format isotype control at nine doses each: 10 µg/mL, 2 µg/mL, 0.4 µg/mL, 80 ng/mL, 16 ng/mL, 3.2 ng/mL, 0.64 ng/mL, 0.13 ng/mL, and 0.026 ng/mL. Cells were stimulated by adding 1 µg/ml anti-CD3 antibodies and 2 µg/ml anti-CD28 antibodies.

FIG. 15B shows production of cytokine (IL-2) from activated T blasts from a healthy human donor (Donor 2, FIG. 15B) after treatment with anti-GITR IgG4 TM format antibody ABP1, IgG4 TM format control ("IsoTM"), SEC4, SEC9, recombinant hGITRL and IgG1 and IgG4 isotype controls. Activated CD4+/CD8+ T cells were treated with medium alone, recombinant GITR-Ligand, ABP1, hIgG4 TM Format isotype control, SEC4, SEC9, IgG1 standard format isotype control, or hIgG1 standard format isotype control at nine doses each: 10 µg/mL, 2 µg/mL, 0.4 µg/mL, 80 ng/mL, 16 ng/mL, 3.2 ng/mL, 0.64 ng/mL, 0.13 ng/mL, and 0.026 ng/mL. Cells were stimulated by adding 1 µg/ml anti-CD3 antibodies and 2 µg/ml anti-CD28 antibodies.

FIG. 15C (Donor 1) shows the same data for ABP1 as in FIG. 15A with a calculation of the $EC_{50}$ determination.

FIG. 15D (Donor 2) shows the same data for ABP1 as in FIG. 15B with a calculation of the $EC_{50}$ determination.

DETAILED DESCRIPTION

Definitions

Unless otherwise defined, all terms of art, notations and other scientific terminology used herein are intended to have the meanings commonly understood by those of skill in the art to which this invention pertains. In some cases, terms with commonly understood meanings are defined herein for clarity and/or for ready reference, and the inclusion of such definitions herein should not necessarily be construed to represent a difference over what is generally understood in the art. The techniques and procedures described or referenced herein are generally well understood and commonly employed using conventional methodologies by those skilled in the art, such as, for example, the widely utilized molecular cloning methodologies described in Sambrook et al., *Molecular Cloning: A Laboratory Manual* 4th ed. (2012) Cold Spring Harbor Laboratory Press, Cold Spring Harbor, N.Y. As appropriate, procedures involving the use of commercially available kits and reagents are generally carried out in accordance with manufacturer-defined protocols and conditions unless otherwise noted.

As used herein, the singular forms "a," "an," and "the" include the plural referents unless the context clearly indicates otherwise. The terms "include," "such as," and the like are intended to convey inclusion without limitation, unless otherwise specifically indicated.

As used herein, the term "comprising" also specifically includes embodiments "consisting of" and "consisting essentially of" the recited elements, unless specifically indicated otherwise. For example, a multispecific ABP "comprising a diabody" includes a multispecific ABP "consisting of a diabody" and a multispecific ABP "consisting essentially of a diabody."

The term "about" indicates and encompasses an indicated value and a range above and below that value. In certain embodiments, the term "about" indicates the designated value±10%, ±5%, or ±1%. In certain embodiments, the term "about" indicates the designated value±one standard deviation of that value.

The terms "GITR," "GITR protein," and "GITR antigen" are used interchangeably herein to refer to human GITR, or any variants (e.g., splice variants and allelic variants), isoforms, and species homologs of human GITR that are naturally expressed by cells, or that are expressed by cells transfected with a gitr gene. In some aspects, the GITR protein is a GITR protein naturally expressed by a primate (e.g., a monkey or a human), a rodent (e.g., a mouse or a rat), a dog, a camel, a cat, a cow, a goat, a horse, or a sheep. In some aspects, the GITR protein is human GITR (hGITR; SEQ ID NO: 1). In some aspects, the GITR protein is a human GITR T43R variant (hGITR-T43R; SEQ ID NO: 2). In some aspects, the GITR protein comprises the extracellular domain of hGITR, located at positions 26-162 of SEQ ID NOs: 1-2. In some aspects, the GITR protein is a cynomolgus monkey GITR (cGITR; SEQ ID NO: 3). In some aspects, the GITR protein comprises the extracellular domain of cGITR, located at positions 20-156 of SEQ ID NOs: 3. In some aspects, the GITR protein is a murine GITR (mGITR; SEQ ID NO: 4). In some aspects, the GITR protein comprises the extracellular domain of mGITR, located at positions 20-153 of SEQ ID NOs: 4. In some aspects, the GITR protein is a full-length or unprocessed GITR protein. In some aspects, the GITR protein is a truncated or processed GITR protein produced by post-translational modification. GITR is also known by a variety of synonyms, including tumor necrosis factor receptor superfamily, member 18 (TNFRSF18); AITR, glucocorticoid-induced TNFR-related protein; activation-inducible TNFR family receptor; TNF receptor superfamily activation-inducible protein; CD357; and GITR-D.

The term "immunoglobulin" refers to a class of structurally related proteins generally comprising two pairs of polypeptide chains: one pair of light (L) chains and one pair of heavy (H) chains. In an "intact immunoglobulin," all four of these chains are interconnected by disulfide bonds. The structure of immunoglobulins has been well characterized. See, e.g., Paul, Fundamental Immunology 7th ed., Ch. 5 (2013) Lippincott Williams & Wilkins, Philadelphia, Pa. Briefly, each heavy chain typically comprises a heavy chain variable region ($V_H$) and a heavy chain constant region ($C_H$). The heavy chain constant region typically comprises three domains, abbreviated $C_{H1}$, $C_{H2}$, and $C_{H3}$. Each light chain typically comprises a light chain variable region ($V_L$) and a light chain constant region. The light chain constant region typically comprises one domain, abbreviated $C_L$.

The term "antigen-binding protein" (ABP) refers to a protein comprising one or more antigen-binding domains that specifically bind to an antigen or epitope. In some embodiments, the antigen-binding domain binds the antigen or epitope with specificity and affinity similar to that of naturally occurring antibodies. In some embodiments, the ABP comprises, consists of, or consists essentially of an antibody. In some embodiments, the ABP comprises, consists of, or consists essentially of an antibody fragment. In some embodiments, the ABP comprises, consists of, or consists essentially of an alternative scaffold. A "GITR ABP," "anti-GITR ABP," or "GITR-specific ABP" is an ABP, as provided herein, which specifically binds to the antigen GITR. In some embodiments, the ABP binds the extracellular domain of GITR. In certain embodiments, a GITR ABP provided herein binds to an epitope of GITR that is conserved between or among GITR proteins from different species.

The term "antibody" is used herein in its broadest sense and includes certain types of immunoglobulin molecules comprising one or more antigen-binding domains that specifically bind to an antigen or epitope. An antibody specifically includes intact antibodies (e.g., intact immunoglobulins), antibody fragments, and multi-specific antibodies. One example of an antigen-binding domain is an antigen-binding domain formed by a $V_H$-$V_L$ dimer. An antibody is one type of ABP.

The term "alternative scaffold" refers to a molecule in which one or more regions may be diversified to produce one or more antigen-binding domains that specifically bind to an antigen or epitope. In some embodiments, the antigen-binding domain binds the antigen or epitope with specificity and affinity similar to that of naturally occurring antibodies. Exemplary alternative scaffolds include those derived from fibronectin (e.g., Adnectins™), the β-sandwich (e.g., iMab), lipocalin (e.g., Anticalins®), EETI-II/AGRP, BPTI/LACI-D1/ITI-D2 (e.g., Kunitz domains), thioredoxin peptide aptamers, protein A (e.g., Affibody®), ankyrin repeats (e.g., DARPins), gamma-B-crystallin/ubiquitin (e.g., Affilins), CTLD$_3$ (e.g., Tetranectins), Fynomers, and (LDLR-A module) (e.g., Avimers). Additional information on alternative scaffolds is provided in Binz et al., Nat. Biotechnol., 2005 23:1257-1268; Skerra, Current Opin. in Biotech., 2007 18:295-304; and Silacci et al., J. Biol. Chem., 2014, 289: 14392-14398; each of which is incorporated by reference in its entirety. An alternative scaffold is one type of ABP.

The term "antigen-binding domain" means the portion of an ABP that is capable of specifically binding to an antigen or epitope.

The terms "full length antibody," "intact antibody," and "whole antibody" are used herein interchangeably to refer to an antibody having a structure substantially similar to a naturally occurring antibody structure and having heavy chains that comprise an Fc region.

The term "Fc region" means the C-terminal region of an immunoglobulin heavy chain that, in naturally occurring antibodies, interacts with Fc receptors and certain proteins of the complement system. The structures of the Fc regions of various immunoglobulins, and the glycosylation sites contained therein, are known in the art. See Schroeder and Cavacini, J. Allergy Clin. Immunol., 2010, 125:S41-52, incorporated by reference in its entirety. The Fc region may be a naturally occurring Fc region, or an Fc region modified as described elsewhere in this disclosure.

The $V_H$ and $V_L$ regions may be further subdivided into regions of hypervariability ("hypervariable regions (HVRs);" also called "complementarity determining regions" (CDRs)) interspersed with regions that are more conserved. The more conserved regions are called framework regions (FRs). Each $V_H$ and $V_L$ generally comprises three CDRs and four FRs, arranged in the following order (from N-terminus to C-terminus): FR1-CDR1-FR2-CDR2-FR3-CDR3-FR4. The CDRs are involved in antigen binding, and influence antigen specificity and binding affinity of the antibody. See Kabat et al., Sequences of Proteins of Immunological Interest 5th ed. (1991) Public Health Service, National Institutes of Health, Bethesda, Md., incorporated by reference in its entirety.

The light chain from any vertebrate species can be assigned to one of two types, called kappa (κ) and lambda (λ), based on the sequence of its constant domain.

The heavy chain from any vertebrate species can be assigned to one of five different classes (or isotypes): IgA, IgD, IgE, IgG, and IgM. These classes are also designated α, δ, ε, γ, and μ, respectively. The IgG and IgA classes are further divided into subclasses on the basis of differences in sequence and function. Humans express the following subclasses: IgG1, IgG2, IgG3, IgG4, IgA1, and IgA2.

The amino acid sequence boundaries of a CDR can be determined by one of skill in the art using any of a number of known numbering schemes, including those described by Kabat et al., supra ("Kabat" numbering scheme); Al-Lazikani et al., 1997, J. Mol. Biol., 273:927-948 ("Chothia" numbering scheme); MacCallum et al., 1996, J. Mol. Biol. 262:732-745 ("Contact" numbering scheme); Lefranc et al., Dev. Comp. Immunol., 2003, 27:55-77 ("IMGT" numbering scheme); and Honegge and Plückthun, J. Mol. Biol., 2001, 309:657-70 ("AHo" numbering scheme); each of which is incorporated by reference in its entirety.

Table 1 provides the positions of CDR-L1, CDR-L2, CDR-L3, CDR-H1, CDR-H2, and CDR-H3 as identified by the Kabat and Chothia schemes. For CDR-H1, residue numbering is provided using both the Kabat and Chothia numbering schemes.

Unless otherwise specified, the numbering scheme used for identification of a particular CDR herein is the Kabat/Chothia numbering scheme. Where the residues encompassed by these two numbering schemes diverge (e.g., CDR-H1 and/or CDR-H2), the numbering scheme is specified as either Kabat or Chothia. For convenience, CDR-H3 is sometimes referred to herein as either Kabat or Chothia. However, this is not intended to imply differences in sequence where they do not exist, and one of skill in the art can readily confirm whether the sequences are the same or different by examining the sequences.

CDRs may be assigned, for example, using antibody numbering software, such as Abnum, available at www.bioinf.org.uk/abs/abnum/, and described in Abhinandan and Martin, Immunology, 2008, 45:3832-3839, incorporated by reference in its entirety.

TABLE 1

Residues in CDRs according to Kabat and Chothia numbering schemes.

| CDR | Kabat | Chothia |
|---|---|---|
| L1 | L24-L34 | L24-L34 |
| L2 | L50-L56 | L50-L56 |
| L3 | L89-L97 | L89-L97 |
| H1 (Kabat Numbering) | H31-H35B | H26-H32 or H34* |
| H1 (Chothia Numbering) | H31-H35 | H26-H32 |
| H2 | H50-H65 | H52-H56 |
| H3 | H95-H102 | H95-H102 |

*The C-terminus of CDR-H1, when numbered using the Kabat numbering convention, varies between H32 and H34, depending on the length of the CDR.

The "EU numbering scheme" is generally used when referring to a residue in an antibody heavy chain constant region (e.g., as reported in Kabat et al., supra). Unless stated otherwise, the EU numbering scheme is used to refer to residues in antibody heavy chain constant regions described herein.

An "antibody fragment" or "antigen-binding fragment" comprises a portion of an intact antibody, such as the antigen-binding or variable region of an intact antibody. Antibody fragments include, for example, Fv fragments, Fab fragments, F(ab')2 fragments, Fab' fragments, scFv (sFv) fragments, and scFv-Fc fragments.

"Fv" fragments comprise a non-covalently-linked dimer of one heavy chain variable domain and one light chain variable domain.

"Fab" fragments comprise, in addition to the heavy and light chain variable domains, the constant domain of the light chain and the first constant domain ($C_{H1}$) of the heavy chain. Fab fragments may be generated, for example, by recombinant methods or by papain digestion of a full-length antibody.

"F(ab')2" fragments contain two Fab' fragments joined, near the hinge region, by disulfide bonds. F(ab')2 fragments may be generated, for example, by recombinant methods or by pepsin digestion of an intact antibody. The F(ab') fragments can be dissociated, for example, by treatment with B-mercaptoethanol.

"Single-chain Fv" or "sFv" or "scFv" antibody fragments comprise a $V_H$ domain and a $V_L$ domain in a single polypeptide chain. The $V_H$ and $V_L$ are generally linked by a peptide linker. See Plückthun A. (1994). In some embodiments, the linker is a $(GGGGS)_n$ (SEQ ID NO: 5). In other embodiments, the linker is GGGGSGGGGSGGGGS (SEQ ID NO:6). In some embodiments, n=1, 2, 3, 4, 5, or 6. See Antibodies from *Escherichia coli*. In Rosenberg M. & Moore G. P. (Eds.), *The Pharmacology of Monoclonal Antibodies* vol. 113 (pp. 269-315). Springer-Verlag, New York, incorporated by reference in its entirety.

"scFv-Fc" fragments comprise an scFv attached to an Fc domain. For example, an Fc domain may be attached to the C-terminal of the scFv. The Fc domain may follow the $V_H$ or $V_L$, depending on the orientation of the variable domains in the scFv (i.e., $V_H$-$V_L$ or $V_L$-$V_H$). Any suitable Fc domain known in the art or described herein may be used. In some cases, the Fc domain comprises an IgG4 Fc domain.

The term "single domain antibody" refers to a molecule in which one variable domain of an antibody specifically binds to an antigen without the presence of the other variable domain. Single domain antibodies, and fragments thereof, are described in Arabi Ghahroudi et al., *FEBS Letters*, 1998, 414:521-526 and Muyldermans et al., *Trends in Biochem. Sci.*, 2001, 26:230-245, each of which is incorporated by reference in its entirety.

A "multispecific ABP" is an ABP that comprises two or more different antigen-binding domains that collectively specifically bind two or more different epitopes. The two or more different epitopes may be epitopes on the same antigen (e.g., a single GITR molecule expressed by a cell) or on different antigens (e.g., different GITR molecules expressed by the same cell). In some aspects, a multi-specific ABP binds two different epitopes (i.e., a "bispecific ABP"). In some aspects, a multi-specific ABP binds three different epitopes (i.e., a "trispecific ABP"). In some aspects, a multi-specific ABP binds four different epitopes (i.e., a "quadspecific ABP"). In some aspects, a multi-specific ABP binds six different epitopes (i.e., a "quintspecific ABP"). In some aspects, a multi-specific ABP binds 6, 7, 8, or more different epitopes. Each binding specificity may be present in any suitable valency. Examples of multispecific ABPs are provided elsewhere in this disclosure.

A "monospecific ABP" is an ABP that comprises a binding site that specifically binds to a single epitope. An example of a monospecific ABP is a naturally occurring IgG molecule which, while divalent, recognizes the same epitope at each antigen-binding domain. The binding specificity may be present in any suitable valency.

The term "monoclonal antibody" refers to an antibody from a population of substantially homogeneous antibodies. A population of substantially homogeneous antibodies comprises antibodies that are substantially similar and that bind the same epitope(s), except for variants that may normally arise during production of the monoclonal antibody. Such variants are generally present in only minor amounts. A monoclonal antibody is typically obtained by a process that includes the selection of a single antibody from a plurality of antibodies. For example, the selection process can be the selection of a unique clone from a plurality of clones, such as a pool of hybridoma clones, phage clones, yeast clones, bacterial clones, or other recombinant DNA clones. The selected antibody can be further altered, for example, to improve affinity for the target ("affinity maturation"), to humanize the antibody, to improve its production in cell culture, and/or to reduce its immunogenicity in a subject.

The term "chimeric antibody" refers to an antibody in which a portion of the heavy and/or light chain is derived from a particular source or species, while the remainder of the heavy and/or light chain is derived from a different source or species.

"Humanized" forms of non-human antibodies are chimeric antibodies that contain minimal sequence derived from the non-human antibody. A humanized antibody is generally a human antibody (recipient antibody) in which residues from one or more CDRs are replaced by residues from one or more CDRs of a non-human antibody (donor antibody). The donor antibody can be any suitable non-human antibody, such as a mouse, rat, rabbit, chicken, or non-human primate antibody having a desired specificity, affinity, or biological effect. In some instances, selected framework region residues of the recipient antibody are replaced by the corresponding framework region residues from the donor antibody. Humanized antibodies may also comprise residues that are not found in either the recipient antibody or the donor antibody. Such modifications may be made to further refine antibody function. For further details, see Jones et al., *Nature*, 1986, 321:522-525; Riechmann et al., *Nature*, 1988, 332:323-329; and Presta, *Curr. Op. Struct. Biol.,* 1992, 2:593-596, each of which is incorporated by reference in its entirety.

A "human antibody" is one which possesses an amino acid sequence corresponding to that of an antibody produced by a human or a human cell, or derived from a non-human source that utilizes a human antibody repertoire or human antibody-encoding sequences (e.g., obtained from human sources or designed de novo). Human antibodies specifically exclude humanized antibodies.

An "isolated ABP" or "isolated nucleic acid" is an ABP or nucleic acid that has been separated and/or recovered from a component of its natural environment. Components of the natural environment may include enzymes, hormones, and other proteinaceous or nonproteinaceous materials. In some embodiments, an isolated ABP is purified to a degree sufficient to obtain at least 15 residues of N-terminal or internal amino acid sequence, for example by use of a spinning cup sequenator. In some embodiments, an isolated ABP is purified to homogeneity by gel electrophoresis (e.g., SDS-PAGE) under reducing or nonreducing conditions, with detection by Coomassie® blue or silver stain. An isolated ABP includes an ABP in situ within recombinant cells, since at least one component of the ABP's natural environment is not present. In some aspects, an isolated ABP or isolated nucleic acid is prepared by at least one purification step. In some embodiments, an isolated ABP or isolated nucleic acid is purified to at least 80%, 85%, 90%, 95%, or 99% by weight. In some embodiments, an isolated ABP or isolated nucleic acid is purified to at least 80%, 85%, 90%, 95%, or 99% by volume. In some embodiments, an isolated ABP or isolated nucleic acid is provided as a solution comprising at least 85%, 90%, 95%, 98%, 99% to 100% ABP or nucleic acid by weight. In some embodiments, an isolated ABP or isolated nucleic acid is provided as a solution comprising at least 85%, 90%, 95%, 98%, 99% to 100% ABP or nucleic acid by volume.

"Affinity" refers to the strength of the sum total of non-covalent interactions between a single binding site of a molecule (e.g., an ABP) and its binding partner (e.g., an antigen or epitope). Unless indicated otherwise, as used herein, "affinity" refers to intrinsic binding affinity, which reflects a 1:1 interaction between members of a binding pair (e.g., ABP and antigen or epitope). The affinity of a molecule X for its partner Y can be represented by the dissociation equilibrium constant ($K_D$). The kinetic components that contribute to the dissociation equilibrium constant are described in more detail below. Affinity can be measured by common methods known in the art, including those described herein. Affinity can be determined, for example, using surface plasmon resonance (SPR) technology (e.g., BIACORE) or biolayer interferometry (e.g., FORTEBIO®).

With regard to the binding of an ABP to a target molecule, the terms "bind," "specific binding," "specifically binds to," "specific for," "selectively binds," and "selective for" a particular antigen (e.g., a polypeptide target) or an epitope on a particular antigen mean binding that is measurably different from a non-specific or non-selective interaction (e.g., with a non-target molecule). Specific binding can be measured, for example, by measuring binding to a target molecule and comparing it to binding to a non-target molecule. Specific binding can also be determined by competition with a control molecule that mimics the epitope recognized on the target molecule. In that case, specific binding is indicated if the binding of the ABP to the target molecule is competitively inhibited by the control molecule. In some aspects, the affinity of a GITR ABP for a non-target molecule is less than about 50% of the affinity for GITR. In some aspects, the affinity of a GITR ABP for a non-target molecule is less than about 40% of the affinity for GITR. In some aspects, the affinity of a GITR ABP for a non-target molecule is less than about 30% of the affinity for GITR. In some aspects, the affinity of a GITR ABP for a non-target molecule is less than about 20% of the affinity for GITR. In some aspects, the affinity of a GITR ABP for a non-target molecule is less than about 10% of the affinity for GITR. In some aspects, the affinity of a GITR ABP for a non-target molecule is less than about 1% of the affinity for GITR. In some aspects, the affinity of a GITR ABP for a non-target molecule is less than about 0.1% of the affinity for GITR.

The term "$k_d$" ($sec^{-1}$), as used herein, refers to the dissociation rate constant of a particular ABP-antigen interaction. This value is also referred to as the $k_{off}$ value.

The term "$k_a$" ($M^{-1} \times sec^{-1}$), as used herein, refers to the association rate constant of a particular ABP-antigen interaction. This value is also referred to as the $k_{on}$ value.

The term "$K_D$" (M), as used herein, refers to the dissociation equilibrium constant of a particular ABP-antigen interaction. $K_D = k_d/k_a$.

The term "$K_A$" ($M^{-1}$), as used herein, refers to the association equilibrium constant of a particular ABP-antigen interaction. $K_A = k_a/k_d$.

An "affinity matured" ABP is one with one or more alterations (e.g., in one or more CDRs or FRs) that result in an improvement in the affinity of the ABP for its antigen, compared to a parent ABP which does not possess the alteration(s). In one embodiment, an affinity matured ABP has nanomolar or picomolar affinity for the target antigen Affinity matured ABPs may be produced using a variety of methods known in the art. For example, Marks et al. (*Bio/Technology,* 1992, 10:779-783, incorporated by reference in its entirety) describes affinity maturation by $V_H$ and $V_L$ domain shuffling. Random mutagenesis of CDR and/or framework residues is described by, for example, Barbas et al. (*Proc. Nat. Acad. Sci. U.S.A.,* 1994, 91:3809-3813); Schier et al., *Gene,* 1995, 169:147-155; Yelton et al., *J. Immunol.,* 1995, 155:1994-2004; Jackson et al., *J. Immunol.,* 1995, 154:3310-33199; and Hawkins et al, *J. Mol. Biol.,* 1992, 226:889-896; each of which is incorporated by reference in its entirety.

An "immunoconjugate" is an ABP conjugated to one or more heterologous molecule(s).

"Effector functions" refer to those biological activities mediated by the Fc region of an antibody, which activities may vary depending on the antibody isotype. Examples of antibody effector functions include C1q binding to activate complement dependent cytotoxicity (CDC), Fc receptor binding to activate antibody-dependent cellular cytotoxicity (ADCC), and antibody dependent cellular phagocytosis (ADCP).

When used herein in the context of two or more ABPs, the term "competes with" or "cross-competes with" indicates that the two or more ABPs compete for binding to an antigen (e.g., GITR). In one exemplary assay, GITR is coated on a surface and contacted with a first GITR ABP, after which a second GITR ABP is added. In another exemplary assay, a first GITR ABP is coated on a surface and contacted with GITR, and then a second GITR ABP is added. If the presence of the first GITR ABP reduces binding of the second GITR ABP, in either assay, then the ABPs compete. The term "competes with" also includes combinations of ABPs where one ABP reduces binding of another ABP, but where no competition is observed when the ABPs are added in the reverse order. However, in some embodiments, the first and second ABPs inhibit binding of each other, regardless of the order in which they are added. In some embodiments, one ABP reduces binding of another ABP to its antigen by at least 50%, at least 60%, at least 70%, at least 80%, or at least 90%.

The term "epitope" means a portion of an antigen the specifically binds to an ABP. Epitopes frequently consist of surface-accessible amino acid residues and/or sugar side chains and may have specific three dimensional structural characteristics, as well as specific charge characteristics. Conformational and non-conformational epitopes are distinguished in that the binding to the former but not the latter may be lost in the presence of denaturing solvents. An epitope may comprise amino acid residues that are directly involved in the binding, and other amino acid residues, which are not directly involved in the binding. The epitope to which an ABP binds can be determined using known techniques for epitope determination such as, for example, testing for ABP binding to GITR variants with different point-mutations, or to chimeric GITR variants.

Percent "identity" between a polypeptide sequence and a reference sequence, is defined as the percentage of amino acid residues in the polypeptide sequence that are identical to the amino acid residues in the reference sequence, after aligning the sequences and introducing gaps, if necessary, to achieve the maximum percent sequence identity. Alignment for purposes of determining percent amino acid sequence identity can be achieved in various ways that are within the skill in the art, for instance, using publicly available computer software such as BLAST, BLAST-2, ALIGN, MEGALIGN (DNASTAR), CLUSTALW, CLUSTAL OMEGA, or MUSCLE software. Those skilled in the art can determine appropriate parameters for aligning sequences, including any algorithms needed to achieve maximal alignment over the full length of the sequences being compared.

A "conservative substitution" or a "conservative amino acid substitution," refers to the substitution an amino acid with a chemically or functionally similar amino acid. Conservative substitution tables providing similar amino acids are well known in the art. By way of example, the groups of amino acids provided in Tables 2-4 are, in some embodiments, considered conservative substitutions for one another.

TABLE 2

Selected groups of amino acids that are considered conservative substitutions for one another, in certain embodiments.

| | |
|---|---|
| Acidic Residues | D and E |
| Basic Residues | K, R, and H |
| Hydrophilic Uncharged Residues | S, T, N, and Q |
| Aliphatic Uncharged Residues | G, A, V, L, and I |
| Non-polar Uncharged Residues | C, M, and P |
| Aromatic Residues | F, Y, and W |

TABLE 3

Additional selected groups of amino acids that are considered conservative substitutions for one another, in certain embodiments.

| | |
|---|---|
| Group 1 | A, S, and T |
| Group 2 | D and E |
| Group 3 | N and Q |
| Group 4 | R and K |
| Group 5 | I, L, and M |
| Group 6 | F, Y, and W |

TABLE 4

Further selected groups of amino acids that are considered conservative substitutions for one another, in certain embodiments.

| | |
|---|---|
| Group A | A and G |
| Group B | D and E |
| Group C | N and Q |
| Group D | R, K, and H |
| Group E | I, L, M, V |
| Group F | F, Y, and W |
| Group G | S and T |
| Group H | C and M |

Additional conservative substitutions may be found, for example, in Creighton, *Proteins: Structures and Molecular Properties* 2nd ed. (1993) W. H. Freeman & Co., New York, N.Y. An ABP generated by making one or more conservative substitutions of amino acid residues in a parent ABP is referred to as a "conservatively modified variant."

The term "amino acid" refers to the twenty common naturally occurring amino acids. Naturally occurring amino acids include alanine (Ala; A), arginine (Arg; R), asparagine (Asn; N), aspartic acid (Asp; D), cysteine (Cys; C); glutamic acid (Glu; E), glutamine (Gln; Q), Glycine (Gly; G); histidine (His; H), isoleucine (Ile; I), leucine (Leu; L), lysine (Lys; K), methionine (Met; M), phenylalanine (Phe; F), proline (Pro; P), serine (Ser; S), threonine (Thr; T), tryptophan (Trp; W), tyrosine (Tyr; Y), and valine (Val; V).

The term "vector," as used herein, refers to a nucleic acid molecule capable of propagating another nucleic acid to which it is linked. The term includes the vector as a self-replicating nucleic acid structure as well as the vector incorporated into the genome of a host cell into which it has been introduced. Certain vectors are capable of directing the expression of nucleic acids to which they are operatively linked. Such vectors are referred to herein as "expression vectors."

The terms "host cell," "host cell line," and "host cell culture" are used interchangeably and refer to cells into which exogenous nucleic acid has been introduced, including the progeny of such cells. Host cells include "transformants" (or "transformed cells") and "transfectants" (or "transfected cells"), which each include the primary transformed or transfected cell and progeny derived therefrom. Such progeny may not be completely identical in nucleic acid content to a parent cell, and may contain mutations.

The term "treating" (and variations thereof such as "treat" or "treatment") refers to clinical intervention in an attempt to alter the natural course of a disease or condition in a subject in need thereof. Treatment can be performed both for prophylaxis and during the course of clinical pathology. Desirable effects of treatment include preventing occurrence or recurrence of disease, alleviation of symptoms, diminishment of any direct or indirect pathological consequences of the disease, preventing metastasis, decreasing the rate of disease progression, amelioration or palliation of the disease state, and remission or improved prognosis.

As used herein, the term "therapeutically effective amount" or "effective amount" refers to an amount of an ABP or pharmaceutical composition provided herein that, when administered to a subject, is effective to treat a disease or disorder.

As used herein, the term "subject" means a mammalian subject. Exemplary subjects include humans, monkeys, dogs, cats, mice, rats, cows, horses, camels, goats, rabbits, and sheep. In certain embodiments, the subject is a human. In some embodiments the subject has a disease or condition that can be treated with an ABP provided herein. In some aspects, the disease or condition is a cancer.

The term "package insert" is used to refer to instructions customarily included in commercial packages of therapeutic or diagnostic products (e.g., kits) that contain information about the indications, usage, dosage, administration, combination therapy, contraindications and/or warnings concerning the use of such therapeutic or diagnostic products.

The term "cytotoxic agent," as used herein, refers to a substance that inhibits or prevents a cellular function and/or causes cell death or destruction.

A "chemotherapeutic agent" refers to a chemical compound useful in the treatment of cancer. Chemotherapeutic agents include "anti-hormonal agents" or "endocrine therapeutics" which act to regulate, reduce, block, or inhibit the effects of hormones that can promote the growth of cancer.

The term "cytostatic agent" refers to a compound or composition which arrests growth of a cell either in vitro or in vivo. In some embodiments, a cytostatic agent is an agent that reduces the percentage of cells in S phase. In some embodiments, a cytostatic agent reduces the percentage of cells in S phase by at least about 20%, at least about 40%, at least about 60%, or at least about 80%.

The term "tumor" refers to all neoplastic cell growth and proliferation, whether malignant or benign, and all precancerous and cancerous cells and tissues. The terms "cancer," "cancerous," "cell proliferative disorder," "proliferative disorder" and "tumor" are not mutually exclusive as referred to herein. The terms "cell proliferative disorder" and "proliferative disorder" refer to disorders that are associated with some degree of abnormal cell proliferation. In some embodiments, the cell proliferative disorder is a cancer.

The term "pharmaceutical composition" refers to a preparation which is in such form as to permit the biological activity of an active ingredient contained therein to be effective in treating a subject, and which contains no additional components which are unacceptably toxic to the subject.

The terms "modulate" and "modulation" refer to reducing or inhibiting or, alternatively, activating or increasing, a recited variable.

The terms "increase" and "activate" refer to an increase of 10%, 20%, 30%, 40%, 50%, 60%, 70%, 75%, 80%, 85%, 90%, 95%, 100%, 2-fold, 3-fold, 4-fold, 5-fold, 10-fold, 20-fold, 50-fold, 100-fold, or greater in a recited variable, such as GITR signaling activity.

The terms "reduce" and "inhibit" refer to a decrease of 10%, 20%, 30%, 40%, 50%, 60%, 70%, 75%, 80%, 85%, 90%, 95%, 2-fold, 3-fold, 4-fold, 5-fold, 10-fold, 20-fold, 50-fold, 100-fold, or greater in a recited variable, such as (a) a number of regulatory T cells and/or (b) the symptoms of a disease or condition, such as the presence or size of metastases or the size of a primary tumor.

The term "agonize" refers to the activation of receptor signaling to induce a biological response associated with activation of the receptor. An "agonist" is an entity, such as an ABP provided herein, that binds to and agonizes a receptor.

The term "antagonize" refers to the inhibition of receptor signaling to inhibit a biological response associated with activation of the receptor. An "antagonist" is an entity, such as an ABP, that binds to and antagonizes a receptor.

The term "multimerize" refers to the act of forming "multimers" of an entity by assembling the entity to form a supra-entity structure held together by non-covalent or covalent interactions. Multimers include "homo-multimers," which are assemblies formed from multiple units of the same entity, or "hetero-multimers," which are assemblies comprising at least one unit of a first entity and at least one unit of a second entity. When used herein to refer to GITR, the term multimerize refers to the assembly of multiple GITR molecules expressed on the surface of a cell that is induced, for example, by binding of an ABP provided herein or by GITRL. Such multimerization is associated with the activation of GITR signaling. See Nocentini et al., *Br. J. Pharmacol.*, 2012, 165:2089-2099, incorporated by reference in its entirety.

The term "effector T cell" includes T helper (i.e., CD4+) cells and cytotoxic (i.e., CD8+) T cells. CD4+ effector T cells contribute to the development of several immunologic processes, including maturation of B cells into plasma cells and memory B cells, and activation of cytotoxic T cells and macrophages. CD8+ effector T cells destroy virus-infected cells and tumor cells. See Seder and Ahmed, *Nature Immunol.*, 2003, 4:835-842, incorporated by reference in its entirety, for additional information on effector T cells.

The term "regulatory T cell" includes cells that regulate immunological tolerance, for example, by suppressing effector T cells. In some aspects, the regulatory T cell has a CD4+CD25+Foxp3+ phenotype. In some aspects, the regulatory T cell has a CD8+CD25+ phenotype. See Nocentini et al., *Br. J. Pharmacol.*, 2012, 165:2089-2099, incorporated by reference in its entirety, for additional information on regulatory T cells expressing GITR.

The term "dendritic cell" refers to a professional antigen-presenting cell capable of activating a naïve T cell and stimulating growth and differentiation of a B cell.

GITR Antigen-Binding Proteins.

1.1. GITR Binding and Target Cells

Provided herein are ABPs that specifically bind to GITR. In some aspects, the GITR is hGITR (SEQ ID NO: 1). In some aspects, the GITR is hGITR-T43R (SEQ ID NO: 2). In some aspects, the GITR is cGITR (SEQ ID NO: 3). In some aspects, the GITR is mGITR (SEQ ID NO: 4).

In some embodiments, the ABPs provided herein specifically bind to hGITR (SEQ ID NO: 1), hGITR-T43R (SEQ ID NO: 2), cGITR (SEQ ID NO: 3), and mGITR (SEQ ID NO: 4). In some embodiments, the ABPs provided herein specifically bind to hGITR (SEQ ID NO: 1), hGITR-T43R (SEQ ID NO: 2), and cGITR (SEQ ID NO: 3). In some embodiments, the ABPs provided herein specifically bind to hGITR (SEQ ID NO: 1) and hGITR-T43R (SEQ ID NO: 2). In some embodiments, the ABPs provided herein do not bind mGITR (SEQ ID NO: 4).

In some embodiments, the ABPs provided herein specifically bind to the extracellular domain of GITR.

The GITR may be expressed on the surface of any suitable target cell. In some embodiments, the target cell is an effector T cell. In some embodiments, the target cell is a regulatory T cell. In some embodiments, the target cell is a natural killer (NK) cell. In some embodiments, the target cell is a natural killer T (NKT) cell. In some embodiments, the target cell is a dendritic cell. In some aspects, the dendritic cell is a plasmacytoid dendritic cell. In some embodiments, the target cell is a B cell. In some aspects, the B cell is a plasma cell. See Nocentini et al., *Br. J. Pharmacol.*, 2012, 165:2089-2099, incorporated by reference in its entirety.

In some embodiments, the ABPs provided herein specifically bind to a GITR monomer.

In some embodiments, the ABPs provided herein specifically bind to a GITR multimer. In some aspects, the multimer comprises two GITR molecules. In some aspects, the multimer comprises three GITR molecules. In some aspects, the multimer comprises four GITR molecules. In some aspects, the multimer comprises five GITR molecules. In some aspects, the multimer comprises six GITR molecules. In some aspects, the multimer comprises more than six GITR molecules.

In some embodiments, the ABPs provided herein comprise, consist of, or consist essentially of an immunoglobulin molecule. In some aspects, the immunoglobulin molecule comprises, consists of, or consists essentially of an antibody.

In some embodiments, the ABPs provided herein comprise a light chain. In some aspects, the light chain is a kappa light chain. In some aspects, the light chain is a lambda light chain.

In some embodiments, the ABPs provided herein comprise a heavy chain. In some aspects, the heavy chain is an IgA. In some aspects, the heavy chain is an IgD. In some aspects, the heavy chain is an IgE. In some aspects, the heavy chain is an IgG. In some aspects, the heavy chain is an IgM. In some aspects, the heavy chain is an IgG1. In some aspects, the heavy chain is an IgG2. In some aspects, the heavy chain is an IgG3. In some aspects, the heavy chain is an IgG4. In some aspects, the heavy chain is an IgA1. In some aspects, the heavy chain is an IgA2.

In some embodiments, the ABPs provided herein comprise, consist of, or consist essentially of an antibody fragment. In some aspects, the antibody fragment is an Fv fragment. In some aspects, the antibody fragment is a Fab fragment. In some aspects, the antibody fragment is a F(ab')2 fragment. In some aspects, the antibody fragment is a Fab' fragment. In some aspects, the antibody fragment is an scFv (sFv) fragment. In some aspects, the antibody fragment is an scFv-Fc fragment. In some aspects, the antibody fragment is a fragment of a single domain antibody.

In some embodiments, the ABPs provided herein are monoclonal antibodies. In some embodiments, the ABPs provided herein are polyclonal antibodies.

In some embodiments, the ABPs provided herein comprise, consist of, or consist essentially of chimeric antibodies. In some embodiments, the ABPs provided herein comprise, consist of, or consist essentially of humanized antibodies. In some embodiments, the ABPs provided herein comprise, consist of, or consist essentially of human antibodies.

In some embodiments, the ABPs provided herein comprise, consist of, or consist essentially of affinity matured ABPs. In some aspects, the ABPs are affinity matured ABPs derived from an ABP provided herein.

In some embodiments, the ABPs provided herein comprise, consist of, or consist essentially of an alternative scaffold. Any suitable alternative scaffold may be used. In some aspects, the ABPs provided herein comprise, consist of, or consist essentially of an alternative scaffold selected from an Adnectin™, an iMab, an Anticalin®, an EETI-II/AGRP, a Kunitz domain, a thioredoxin peptide aptamer, an Affibody®, a DARPin, an Affilin, a Tetranectin, a Fynomer, and an Avimer.

In some embodiments, an ABP provided herein inhibits binding of GITR to GITRL. In some aspects, the ABP inhibits binding of GITR to GITRL by at least about 50%. In some aspects, the ABP inhibits binding of GITR to GITRL by at least about 75%. In some aspects, the ABP inhibits binding of GITR to GITRL by at least about 90%. In some aspects, the ABP inhibits binding of GITR to GITRL by at least about 95%.

1.2. Monospecific and Multispecific GITR Antigen-Binding Proteins

In some embodiments, the ABPs provided herein are monospecific ABPs. In some aspects, the monospecific ABPs bind to the same epitope on two or more different GITR molecules. In some aspects, the monospecific ABPs bind to the same epitope on two GITR molecules. In some aspects, the monospecific ABPs bind to the same epitope on three GITR molecules. In some aspects, the monospecific ABPs bind to the same epitope on four GITR molecules. In some aspects, the monospecific ABPs bind to the same epitope on five GITR molecules. In some aspects, the monospecific ABPs bind to the same epitope on six GITR molecules. In some aspects, the monospecific ABPs bind to the same epitope on more than six GITR molecules.

In some embodiments, the monospecific ABPs provided herein are multivalent. As used herein, the term "multivalent" refers to an antibody with, e.g., more than two binding regions (i.e., that comprise $V_H$ and $V_L$ regions). In some aspects, the monospecific ABPs are bivalent. In some aspects, the monospecific ABPs are trivalent. In some aspects, the monospecific ABPs are tetravalent. In some aspects, the monospecific ABPs are pentavalent. In some aspects, the monospecific ABPs are hexavalent. In some aspects, the monospecific ABPs are septivalent. In some aspects, the monospecific ABPs are octavalent.

In some embodiments, the monospecific multivalent ABPs disclosed herein are tetravalent.

In some embodiments, the ABPs provided herein are multispecific ABPs. In some aspects, the multispecific ABPs bind to two or more epitopes on two or more different GITR molecules. In some aspects, the multispecific ABPs bind to two or more epitopes on two GITR molecules. In some aspects, the multispecific ABPs bind to two or more epitopes on three GITR molecules. In some aspects, the multispecific ABPs bind to two or more epitopes on four GITR molecules. In some aspects, the multispecific ABPs bind to two or more epitopes on five GITR molecules. In some aspects, the multispecific ABPs bind to two or more epitopes on six GITR molecules. In some aspects, the multispecific ABPs bind to two or more epitopes on seven GITR molecules. In some aspects, the multispecific ABPs bind to two or more epitopes on eight GITR molecules. In some aspects, the multispecific ABPs bind to two or more epitopes on nine GITR molecules. In some aspects, the multispecific ABPs bind to two or more epitopes on ten GITR molecules. In some aspects, the multispecific ABPs bind to two or more epitopes on eleven GITR molecules. In some aspects, the multispecific ABPs bind to two or more epitopes on twelve GITR molecules. In some aspects, the multispecific ABPs bind to two or more epitopes on more than twelve GITR molecules.

The multispecific ABPs provided herein may bind any suitable number of epitopes on GITR. In some aspects, the multispecific ABPs bind two epitopes on GITR. In some aspects, the multispecific ABPs bind three epitopes on GITR. In some aspects, the multispecific ABPs bind four epitopes on GITR. In some aspects, the multispecific ABPs bind five epitopes on GITR. In some aspects, the multispecific ABPs bind six epitopes on GITR. In some aspects, the multispecific ABPs bind seven epitopes on GITR. In some aspects, the multispecific ABPs bind eight epitopes on GITR. In some aspects, the multispecific ABPs bind nine epitopes on GITR. In some aspects, the multispecific ABPs bind ten epitopes on GITR. In some aspects, the multispecific ABPs bind eleven epitopes on GITR. In some aspects, the multispecific ABPs bind twelve epitopes on GITR. In some aspects, the multispecific ABPs bind more than twelve epitopes on GITR.

In some aspects, a multispecific ABP provided herein binds at least two different epitopes on at least two different GITR molecules. In some aspects, a multispecific ABP provided herein binds at least three different epitopes on at least three different GITR molecules. In some aspects, a multispecific ABP provided herein binds at least four different epitopes on at least four different GITR molecules. In some aspects, a multispecific ABP provided herein binds at least five different epitopes on at least five different GITR molecules.

In some embodiments, a multispecific ABP provided herein comprises a first antigen-binding domain that specifically binds a first epitope on GITR and a second antigen-binding domain that specifically binds a second epitope on GITR, wherein the first epitope and the second epitope are different. In some aspects, the multispecific ABP further comprises one or more additional antigen-binding domains that specifically bind to one or more additional epitopes on GITR, wherein each of the additional epitopes are different from the epitopes bound by the first antigen-binding domain, the second antigen-binding domain, or any other further antigen-binding domains of the ABP.

In some embodiments, a multispecific ABP provided herein binds to an epitope on a GITR molecule and an epitope on another molecule that is not GITR. Any suitable non-GITR molecule may be bound by an ABP provided herein. In some aspects, the non-GITR molecule is another member of the tumor necrosis factor receptor superfamily (TNFRSF). In some aspects, the other member of the TNFRSF is selected from CD27, CD40, EDA2R, EDAR, FAS, LTBR, NGFR, RELT, TNFRSF1A, TNFRSF1B, TNFRSF4, TNFRSF6B, TNFRSF8, TNFRSF9, TNFRSF10A, TNFRSF10B, TNFRSF10C, TNFRSF10D, TFNRSF11A, TNFRSF11B, TNFRSF12A, TNFRSF13B, TNFRSF13C, TNFRSF14, TNFRSF17, TNFRSF18, TNFRSF19, TNFRSF21, and TNFRSF25.

Many multispecific ABP constructs are known in the art, and the ABPs provided herein may be provided in the form of any suitable multispecific suitable construct.

In some embodiments, the multispecific ABP comprises an immunoglobulin comprising at least two different heavy chain variable regions each paired with a common light chain variable region (i.e., a "common light chain antibody"). The common light chain variable region forms a distinct antigen-binding domain with each of the two different heavy chain variable regions. See Merchant et al., *Nature Biotechnol.*, 1998, 16:677-681, incorporated by reference in its entirety.

In some embodiments, the multivalent ABPs disclosed herein comprise an immunoglobulin comprising an antibody or fragment thereof attached to one or more of the N- or C-termini of the heavy or light chains of such immunoglobulin. See, e.g., U.S. Pat. No. 8,722,859 and Coloma and Morrison, *Nature Biotechnol.*, 1997, 15:159-163, each incorporated by reference in its entirety. In some aspects, such ABP comprises a tetravalent bispecific antibody. In some aspects, such ABP comprises a tetravalent monospecific (TM) antibody.

In some embodiments, the multivalent ABP comprises a hybrid immunoglobulin comprising at least two different heavy chain variable regions and at least two different light chain variable regions. See Milstein and Cuello, *Nature,* 1983, 305:537-540; and Staerz and Bevan, *Proc. Natl. Acad. Sci. USA,* 1986, 83:1453-1457; each of which is incorporated by reference in its entirety.

In some embodiments, the multivalent ABP comprises immunoglobulin chains with alterations to reduce the formation of side products that do not have multispecificity. In some aspects, the ABPs comprise one or more "knobs-into-holes" modifications as described in U.S. Pat. No. 5,731,168, incorporated by reference in its entirety.

In some embodiments, the multivalent ABP comprises immunoglobulin chains with one or more electrostatic modifications to promote the assembly of Fc hetero-multimers. See WO 2009/089004, incorporated by reference in its entirety.

In some embodiments, the multivalent ABP comprises a bispecific single chain molecule. See Traunecker et al., *EMBO J.,* 1991, 10:3655-3659; and Gruber et al., *J. Immunol.,* 1994, 152:5368-5374; each of which is incorporated by reference in its entirety.

In some embodiments, the multivalent ABP comprises a heavy chain variable domain and a light chain variable domain, or a single domain antibody $V_HH$ domain, connected by a polypeptide linker, where the length of the linker is selected to promote assembly of multivalent ABPs with the desired multispecificity. For example, monospecific scFvs generally form when a heavy chain V residue prevents pairing of heavy and light chain variable domains on the same polypeptide chain, thereby allowing pairing of heavy and light chain variable domains from one chain with the complementary domains on another chain. The resulting ABPs therefore have multispecificity, with the specificity of each binding site contributed by more than one polypeptide chain. Polypeptide chains comprising heavy and light chain variable domains that are joined by linkers between 3 and 12 amino acid residues form predominantly dimers (termed diabodies). With linkers between 0 and 2 amino acid residues, trimers (termed triabodies) and tetramers (termed tetrabodies) are favored. However, the exact type of oligomerization appears to depend on the amino acid residue composition and the order of the variable domain in each polypeptide chain (e.g., $V_H$-linker-$V_L$ vs. $V_L$-linker-$V_H$), in addition to the linker length. A skilled person can select the appropriate linker length based on the desired multispecificity.

In some embodiments, the monospecific or multispecific ABP comprises a diabody. See Hollinger et al., *Proc. Natl. Acad. Sci. USA,* 1993, 90:6444-6448, incorporated by reference in its entirety. In some embodiments, the monospecific or multispecific ABP comprises a triabody. See Todorovska et al., *J. Immunol. Methods,* 2001, 248:47-66, incorporated by reference in its entirety. In some embodiments, the monospecific or multispecific ABP comprises a tetrabody. See id., incorporated by reference in its entirety.

In some embodiments, the multispecific ABP comprises a trispecific F(ab')3 derivative. See Tutt et al. *J. Immunol.,* 1991, 147:60-69, incorporated by reference in its entirety.

In some embodiments, the monospecific or multispecific ABP comprises a cross-linked antibody. See U.S. Pat. No. 4,676,980; Brennan et al., *Science,* 1985, 229:81-83; Staerz, et al. *Nature,* 1985, 314:628-631; and EP 0453082; each of which is incorporated by reference in its entirety.

In some embodiments, the monospecific or multispecific ABP comprises antigen-binding domains assembled by leucine zippers. See Kostelny et al., *J. Immunol.*, 1992, 148: 1547-1553, incorporated by reference in its entirety.

In some embodiments, the monospecific or multispecific ABP comprises complementary protein domains. In some aspects, the complementary protein domains comprise an anchoring domain (AD) and a dimerization and docking domain (DDD). In some embodiments, the AD and DDD bind to each other and thereby enable assembly of multispecific ABP structures via the "dock and lock" (DNL) approach. ABPs of many specificities may be assembled, including bispecific ABPs, trispecific ABPs, tetraspecific ABPs, pentaspecific ABPs, and hexaspecific ABPs. Multispecific ABPs comprising complementary protein domains are described, for example, in U.S. Pat. Nos. 7,521,056; 7,550,143; 7,534,866; and 7,527,787; each of which is incorporated by reference in its entirety.

In some embodiments, the monospecific or multispecific ABP comprises a hybrid of an antibody molecule and a non-antibody molecule with specificity for GITR or another target. See WO 93/08829, incorporated by reference in its entirety, for examples of such ABPs. In some aspects the non-antibody molecule is GITRL.

In some embodiments, the monospecific or multispecific ABP comprises a dual action Fab (DAF) antibody as described in U.S. Pat. Pub. No. 2008/0069820, incorporated by reference in its entirety.

In some embodiments, the multispecific ABP comprises an antibody formed by reduction of two parental molecules followed by mixing of the two parental molecules and reoxidation to assembly a hybrid structure. See Carlring et al., *PLoS One*, 2011, 6:e22533, incorporated by reference in its entirety.

In some embodiments, the monospecific or multispecific ABP comprises a DVD-Ig™. A DVD-Ig is a dual variable domain immunoglobulin that can bind to two or more antigens. DVD-Igs™ are described in U.S. Pat. No. 7,612,181, incorporated by reference in its entirety.

In some embodiments, the monospecific or multispecific ABP comprises a DART™. DARTs™ are described in Moore et al., *Blood*, 2011, 117:454-451, incorporated by reference in its entirety.

In some embodiments, the multispecific ABP comprises a DuoBody®. DuoBodies® are described in Labrijn et al., *Proc. Natl. Acad. Sci. USA*, 2013, 110:5145-5150; Gramer et al., *mAbs*, 2013, 5:962-972; and Labrijn et al., *Nature Protocols*, 2014, 9:2450-2463; each of which is incorporated by reference in its entirety.

In some embodiments, the monospecific or multispecific ABP disclosed herein comprises an antibody fragment attached to another antibody or fragment. The attachment can be covalent or non-covalent. When the attachment is covalent, it may be in the form of a fusion protein or via a chemical linker. Illustrative examples of multispecific ABPs comprising antibody fragments attached to other antibodies include tetravalent bispecific antibodies, where an scFv is fused to the C-terminus of the $C_{H3}$ from an IgG. See Coloma and Morrison, *Nature Biotechnol.*, 1997, 15:159-163. Other examples include antibodies in which a Fab molecule is attached to the constant region of an immunoglobulin. See Miler et al., *J. Immunol.*, 2003, 170:4854-4861, incorporated by reference in its entirety. Any suitable fragment may be used, including any of the fragments described herein or known in the art.

In some embodiments, the monospecific or multispecific ABP comprises a CovX-Body. CovX-Bodies are described, for example, in Doppalapudi et al., *Proc. Natl. Acad. Sci. USA*, 2010, 107:22611-22616, incorporated by reference in its entirety.

In some embodiments, the monospecific or multispecific ABP comprises an Fcab antibody, where one or more antigen-binding domains are introduced into an Fc region. Fcab antibodies are described in Wozniak-Knopp et al., *Protein Eng. Des. Sel.*, 2010, 23:289-297, incorporated by reference in its entirety.

In some embodiments, the monospecific or multispecific ABP comprises an TandAb® antibody. TandAb® antibodies are described in Kipriyanov et al., *J. Mol. Biol.*, 1999, 293:41-56 and Zhukovsky et al., *Blood*, 2013, 122:5116, each of which is incorporated by reference in its entirety.

In some embodiments, the multispecific ABP comprises a tandem Fab. Tandem Fabs are described in WO 2015/103072, incorporated by reference in its entirety.

In some embodiments, the multispecific ABP comprises a Zybody™. Zybodies™ are described in LaFleur et al., *mAbs*, 2013, 5:208-218, incorporated by reference in its entirety.

1.3. Antigen-Binding Proteins Multimerizing GITR

In some embodiments, the ABPs provided herein multimerize GITR expressed on the surface of a target cell. The ABPs provided herein may be designed, based on their valency and specificity, to multimerize any suitable number of GITR molecules.

In some embodiments, the ABPs provided herein multimerize two GITR molecules. In some embodiments, the ABPs provided herein multimerize three GITR molecules. In some embodiments, the ABPs provided herein multimerize four GITR molecules. In some embodiments, the ABPs provided herein multimerize five GITR molecules. In some embodiments, the ABPs provided herein multimerize six GITR molecules. In some embodiments, the ABPs provided herein multimerize seven GITR molecules. In some embodiments, the ABPs provided herein multimerize eight GITR molecules. In some embodiments, the ABPs provided herein multimerize nine GITR molecules. In some embodiments, the ABPs provided herein multimerize ten GITR molecules. In some embodiments, the ABPs provided herein multimerize eleven GITR molecules. In some embodiments, the ABPs provided herein multimerize twelve GITR molecules.

In some embodiments, the ABPs provided herein multimerize at least two GITR molecules. In some embodiments, the ABPs provided herein multimerize at least three GITR molecules. In some embodiments, the ABPs provided herein multimerize at least four GITR molecules. In some embodiments, the ABPs provided herein multimerize at least five GITR molecules. In some embodiments, the ABPs provided herein multimerize at least six GITR molecules. In some embodiments, the ABPs provided herein multimerize at least seven GITR molecules. In some embodiments, the ABPs provided herein multimerize at least eight GITR molecules. In some embodiments, the ABPs provided herein multimerize at least nine GITR molecules. In some embodiments, the ABPs provided herein multimerize at least ten GITR molecules. In some embodiments, the ABPs provided herein multimerize at least eleven GITR molecules. In some embodiments, the ABPs provided herein multimerize at least twelve GITR molecules.

In some embodiments, the ABPs provided herein multimerize two to twelve GITR molecules. In some embodiments, the ABPs provided herein multimerize three to ten GITR molecules. In some embodiments, the ABPs provided herein multimerize three to six GITR molecules. In some embodiments, the ABPs provided herein multimerize three to five GITR molecules. In some embodiments, the ABPs provided herein multimerize three to four GITR molecules.

1.4. GITR Agonism

In some embodiments, the ABPs provided herein agonize GITR upon binding Such agonism can result from the multimerization of GITR by the ABPs as described elsewhere in this disclosure. See FIG. 1.

In some embodiments, agonism of GITR by an ABP provided herein results in modulation of NF-κB activity in a target cell. See U.S. Pat. No. 7,812,135, herein incorporated by reference in its entirety. In some aspects, agonism of GITR results in modulation of IκB activity or stability in a target cell.

In some embodiments, agonism of GITR by an ABP provided herein results in activation of the MAPK pathway in a target cell. In some aspects, the components of the MAPK pathway that are activated by an ABP provided herein include one or more of p38, JNK, and ERK. See Nocentini et al., *Proc. Natl. Acad. Sci. USA*, 1997, 94:6216-6221; Ronchetti et al., *Eur. J. Immunol.*, 2004, 34:613-622; and Esparza et al., *J. Immunol.*, 2005, 174:7869-7874; each of which is incorporated by reference in its entirety.

In some embodiments, agonism of GITR by an ABP provided herein results in increased secretion of IL-2Rα, IL-2, IL-8, and/or IFNγ by a target cell. See Ronchetti et al., *Eur. J. Immunol.*, 2004, 34:613-622, incorporated by reference in its entirety.

In some embodiments, agonism of GITR by an ABP provided herein increases the proliferation, survival, and/or function of an effector T cell. In some aspects the effector T cell is a CD4+ effector T cell. In some aspects, the effector T cell is a CD8+ effector T cell.

In some embodiments, agonism of GITR by an ABP provided herein abrogates suppression of an effector T cell by a regulatory T cell. In some aspects, the regulatory T cell is a CD4+CD25+Foxp3+ regulatory T cell. In some aspects, the regulatory T cell is a CD8+CD25+ regulatory T cell.

In some embodiments, agonism of GITR by an ABP provided herein alters the frequency of occurrence or distribution of regulatory T cells. In some aspects, the frequency of regulatory T cells is decreased. In some aspects, the frequency of regulatory T cells is reduced in a particular tissue. In some aspects, the intratumoral accumulation of regulatory T cells is decreased, resulting in a more favorable ratio of effector T cells to regulatory T cells, and enhancing CD8+ T cell activity. See Cohen et al., *PLoS One*, 2010, 5:e10436.

In some embodiments, agonism of GITR by an ABP provided herein increases the activity of a natural killer (NK) cell. In some embodiments, agonism of GITR by an ABP provided herein increases the activity of an antigen presenting cell. In some embodiments, agonism of GITR by an ABP provided herein increases the activity of a dendritic cell. In some embodiments, agonism of GITR by an ABP provided herein increases the activity of a B cell.

In some embodiments, agonism of GITR by an ABP provided herein results in an enhancement of an immune response. In some embodiments, agonism of GITR by an ABP provided herein results in the delay of onset of a tumor. In some embodiments, agonism of GITR by an ABP provided herein results in the reduction of the size of a tumor. In some embodiments, agonism of GITR by an ABP provided herein results in a reduction in the number of metastases.

In some embodiments, agonism of GITR by a multivalent monospecific ABP provided herein results in a greater maximum amount of agonism than a bivalent monospecific antibody. In some embodiments, the additional valency results in an effect on the $EC_{50}$ that that is more than the additive effects of each of the binding domains. In some embodiments, a tetravalent monospecific ABP provided herein has a greater maximum amount of agonism than a bivalent monospecific antibody.

In some embodiments, the multispecific ABPs provided herein are more potent agonists of GITR than mixtures of the corresponding monospecific ABPs. For example, if a multispecific ABP provided herein comprises two different epitope specificities (e.g., A and B) then, in some embodiments, the agonism of GITR by such multispecific ABP is greater than the agonism of GITR by a mixture of two monospecific ABPs that each comprise one of the two specificities (e.g., A or B). In some embodiments, the additional specificities of a multispecific ABP provided herein yield a synergistic (i.e., greater than additive) increase in potency when compared to mixtures of monospecific ABPs each having only one of the specificities of the multispecific ABP.

1.5. Affinity of Antigen-Binding Proteins for GITR

In some embodiments, the affinity of an ABP provided herein for GITR as indicated by $K_D$, is less than about $10^{-5}$ M, less than about $10^{-6}$ M, less than about $10^{-7}$ M, less than about $10^{-8}$ M, less than about $10^{-9}$ M, less than about $10^{-10}$ M, less than about $10^{-11}$ M, or less than about $10^{-12}$ M. In some embodiments, the affinity of the ABP is between about $10^{-7}$ M and $10^{-12}$ M. In some embodiments, the affinity of the ABP is between about $10^{-7}$ M and $10^{-11}$ M. In some embodiments, the affinity of the ABP is between about $10^{-7}$ M and $10^{-10}$ M. In some embodiments, the affinity of the ABP is between about $10^{-7}$ M and $10^{-9}$ M. In some embodiments, the affinity of the ABP is between about $10^{-7}$ M and $10^{-8}$ M. In some embodiments, the affinity of the ABP is between about $10^{-8}$ M and $10^{-12}$ M. In some embodiments, the affinity of the ABP is between about $10^{-8}$ M and $10^{-11}$ M. In some embodiments, the affinity of the ABP is between about $10^{-9}$ M and $10^{-11}$ M. In some embodiments, the affinity of the ABP is between $10^{-10}$ M and $10^{-11}$ M.

In some embodiments, the ABPs provided herein specifically bind to hGITR (SEQ ID NO: 1) with a $K_D$ of X and to cGITR with a $K_D$ of ≤10X. In some embodiments, the ABPs provided herein specifically bind to hGITR (SEQ ID NO: 1) with a $K_D$ of X and to cGITR with a $K_D$ of ≤5X. In some embodiments, the ABPs provided herein specifically bind to hGITR (SEQ ID NO: 1) with a $K_D$ of X and to cGITR with a $K_D$ of ≤2X. In some aspects, X is any $K_D$ described in this disclosure. In some aspects, X is 0.01 nM, 0.1 nM, 1 nM, 10 nM, 20 nM, 50 nM, or 100 nM.

In some embodiments, $K_D$, $k_a$, and $k_d$ are determined using surface plasmon resonance (SPR). In some aspects, the SPR analysis utilizes a BIACORE® instrument. In some aspects, the antigen is immobilized on a carboxymethylated dextran biosensor chip (CM4 or CM5) and contacted with an ABP provided herein. Association and dissociation rate constants may be calculated using the BIAevaluation® software and a one-to-one Langmuir binding model. In some aspects, the assay is performed at 25° C. In some aspects, the assay is performed at 37° C.

In some embodiments, $K_D$, $k_a$, and $k_d$ are determined using biolayer interferometry (BLI). Any suitable BLI method may be used. In some aspects, the BLI analysis utilizes a FORTEBIO® instrument. In some aspects, an anti-human IgG Fc capture (AHC) biosensor is used to capture ABPs onto the surface of a sensor. Subsequently, association of the ABP and antigen is monitored by contacting the immobilized ABP with different concentrations of GITR. Dissociation of the antigen and ABP is then measured in a buffer without GITR. Association and dissociation rate constants are calculated using the kinetic modules of the FORTEBIO® Analysis Software. In some aspects, the assay is performed at 30° C.

In other embodiments, $K_D$ may be determined by a radiolabeled antigen-binding assay, as described in Chen et al. *J. Mol. Biol.*, 1999, 293:865-881, incorporated by reference in its entirety.

1.5.1. Glycosylation Variants

In certain embodiments, an ABP provided herein may be altered to increase, decrease or eliminate the extent to which it is glycosylated. Glycosylation of polypeptides is typically either "N-linked" or "O-linked."

"N-linked" glycosylation refers to the attachment of a carbohydrate moiety to the side chain of an asparagine residue. The tripeptide sequences asparagine-X-serine and asparagine-X-threonine, where X is any amino acid except proline, are the recognition sequences for enzymatic attachment of the carbohydrate moiety to the asparagine side chain. Thus, the presence of either of these tripeptide sequences in a polypeptide creates a potential glycosylation site.

"O-linked" glycosylation refers to the attachment of one of the sugars N-acetylgalactosamine, galactose, or xylose to a hydroxyamino acid, most commonly serine or threonine, although 5-hydroxyproline or 5-hydroxylysine may also be used.

Addition or deletion of N-linked glycosylation sites to or from an ABP provided herein may be accomplished by altering the amino acid sequence such that one or more of the above-described tripeptide sequences is created or removed. Addition or deletion of O-linked glycosylation sites may be accomplished by addition, deletion, or substitution of one or more serine or threonine residues in or to (as the case may be) the sequence of an ABP.

In some embodiments, an ABP provided herein comprises a glycosylation motif that is different from a naturally occurring ABP. Any suitable naturally occurring glycosylation motif can be modified in the ABPs provided herein. The structural and glycosylation properties of immunoglobulins, for example, are known in the art and summarized, for example, in Schroeder and Cavacini, *J. Allergy Clin. Immunol.*, 2010, 125:S41-52, incorporated by reference in its entirety.

In some embodiments, an ABP provided herein comprises an IgG1 Fc region with modification to the oligosaccharide attached to asparagine 297 (Asn 297). Naturally occurring IgG1 antibodies produced by mammalian cells typically comprise a branched, biantennary oligosaccharide that is generally attached by an N-linkage to Asn 297 of the $C_{H2}$ domain of the Fc region. See Wright et al., TIBTECH, 1997, 15:26-32, incorporated by reference in its entirety. The oligosaccharide attached to Asn 297 may include various carbohydrates such as mannose, N-acetyl glucosamine (GlcNAc), galactose, and sialic acid, as well as a fucose attached to a GlcNAc in the "stem" of the biantennary oligosaccharide structure.

In some embodiments, the oligosaccharide attached to Asn 297 is modified to create ABPs having altered ADCC. In some embodiments, the oligosaccharide is altered to improve ADCC. In some embodiments, the oligosaccharide is altered to reduce ADCC.

In some aspects, an ABP provided herein comprises an IgG1 domain with reduced fucose content at position Asn 297 compared to a naturally occurring IgG1 domain. Such Fc domains are known to have improved ADCC. See Shields et al., *J. Biol. Chem.*, 2002, 277:26733-26740, incorporated by reference in its entirety. In some aspects, such ABPs do not comprise any fucose at position Asn 297. The amount of fucose may be determined using any suitable method, for example as described in WO 2008/077546, incorporated by reference in its entirety.

In some embodiments, an ABP provided herein comprises a bisected oligosaccharide, such as a biantennary oligosaccharide attached to the Fc region of the ABP that is bisected by GlcNAc. Such ABP variants may have reduced fucosylation and/or improved ADCC function. Examples of such ABP variants are described, for example, in WO 2003/011878; U.S. Pat. No. 6,602,684; and U.S. Pat. Pub. No. 2005/0123546; each of which is incorporated by reference in its entirety.

Other illustrative glycosylation variants are described, for example, in U.S. Pat. Pub. Nos. 2003/0157108, 2004/0093621, 2003/0157108, 2003/0115614, 2002/0164328, 2004/0093621, 2004/0132140, 2004/0110704, 2004/0110282, 2004/0109865; International Pat. Pub. Nos. 2000/61739, 2001/29246, 2003/085119, 2003/084570, 2005/035586, 2005/035778; 2005/053742, 2002/031140; Okazaki et al., *J. Mol. Biol.*, 2004, 336:1239-1249; and Yamane-Ohnuki et al., *Biotech. Bioeng.*, 2004, 87: 614-622; each of which is incorporated by reference in its entirety.

In some embodiments, an ABP provided herein comprises an Fc region with at least one galactose residue in the oligosaccharide attached to the Fc region. Such ABP variants may have improved CDC function. Examples of such ABP variants are described, for example, in WO 1997/30087; WO 1998/58964; and WO 1999/22764; each of which his incorporated by reference in its entirety.

Examples of cell lines capable of producing defucosylated ABPs include Lec13 CHO cells, which are deficient in protein fucosylation (see Ripka et al., *Arch. Biochem. Biophys.*, 1986, 249:533-545; U.S. Pat. Pub. No. 2003/0157108; WO 2004/056312; each of which is incorporated by reference in its entirety), and knockout cell lines, such as alpha-1,6-fucosyltransferase gene or FUT8 knockout CHO cells (see Yamane-Ohnuki et al., *Biotech. Bioeng.*, 2004, 87: 614-622; Kanda et al., *Biotechnol. Bioeng.*, 2006, 94:680-688; and WO 2003/085107; each of which is incorporated by reference in its entirety).

In some embodiments, an ABP provided herein is an aglycosylated ABP. An aglycosylated ABP can be produced using any method known in the art or described herein. In some aspects, an aglycosylated ABP is produced by modifying the ABP to remove all glycosylation sites. In some aspects, the glycosylation sites are removed only from the Fc region of the ABP. In some aspects, an aglycosylated ABP is produced by expressing the ABP in an organism that is not capable of glycosylation, such as *E. coli*, or by expressing the ABP in a cell-free reaction mixture.

In some embodiments, an ABP provided herein has a constant region with reduced effector function compared to a native IgG1 antibody. In some embodiments, the affinity of a constant region of an Fc region of an ABP provided herein for Fc receptor is less than the affinity of a native IgG1 constant region for such Fc receptor.

1.6. Fc Region Amino Acid Sequence Variants

In certain embodiments, an ABP provided herein comprises an Fc region with one or more amino acid substitutions, insertions, or deletions in comparison to a naturally occurring Fc region. In some aspects, such substitutions, insertions, or deletions yield ABPs with altered stability, glycosylation, or other characteristics. In some aspects, such substitutions, insertions, or deletions yield aglycosylated ABPs.

In some aspects, the Fc region of an ABP provided herein is modified to yield an ABP with altered affinity for an Fc receptor, or an ABP that is more immunologically inert. In some embodiments, the ABP variants provided herein possess some, but not all, effector functions. Such ABPs may be useful, for example, when the half-life of the ABP is important in vivo, but when certain effector functions (e.g., complement activation and ADCC) are unnecessary or deleterious.

In some embodiments, the Fc region of an ABP provided herein is a human IgG4 Fc region comprising the hinge stabilizing mutation S228P or L235E. In some embodiment, the IgG4 Fc region comprises the hinge stabilizing mutations S228P and L235E. See Aalberse et al., Immunology, 2002, 105:9-19, incorporated by reference in its entirety. In some embodiments, the IgG4 Fc region comprises one or more of the following mutations: E233P, F234V, and L235A. See Armour et al., *Mol. Immunol.*, 2003, 40:585-593, incorporated by reference in its entirety. In some embodiments, the IgG4 Fc region comprises a deletion at position G236.

In some embodiments, the Fc region of an ABP provided herein is a human IgG1 Fc region comprising one or more mutations to reduce Fc receptor binding. In some aspects, the one or more mutations are in residues selected from S228 (e.g., S228A), L234 (e.g., L234A), L235 (e.g., L235A), D265 (e.g., D265A), and N297 (e.g., N297A). In some aspects, the ABP comprises a PVA236 mutation. PVA236 means that the amino acid sequence ELLG, from amino acid position 233 to 236 of IgG1 or EFLG of IgG4, is replaced by PVA. See U.S. Pat. Pub. No. 2013/0065277, incorporated by reference in its entirety.

In some embodiments, the Fc region of an ABP provided herein is modified as described in Armour et al., *Eur. J. Immunol.*, 1999, 29:2613-2624; WO 1999/058572; and/or U.K. Pat. App. No. 98099518; each of which is incorporated by reference in its entirety.

In some embodiments, the Fc region of an ABP provided herein is a human IgG2 Fc region comprising one or more of mutations A330S and P331S.

In some embodiments, the Fc region of an ABP provided herein has an amino acid substitution at one or more positions selected from 238, 265, 269, 270, 297, 327 and 329. See U.S. Pat. No. 6,737,056, incorporated by reference in its entirety. Such Fc mutants include Fc mutants with substitutions at two or more of amino acid positions 265, 269, 270, 297 and 327, including the so-called "DANA" Fc mutant with substitution of residues 265 and 297 with alanine. See U.S. Pat. No. 7,332,581, incorporated by reference in its entirety. In some embodiments, the ABP comprises an alanine at amino acid position 265. In some embodiments, the ABP comprises an alanine at amino acid position 297.

In certain embodiments, an ABP provided herein comprises an Fc region with one or more amino acid substitutions which improve ADCC, such as a substitution at one or more of positions 298, 333, and 334 of the Fc region. In some embodiments, an ABP provided herein comprises an Fc region with one or more amino acid substitutions at positions 239, 332, and 330, as described in Lazar et al., *Proc. Natl. Acad. Sci. USA*, 2006, 103:4005-4010, incorporated by reference in its entirety.

In some embodiments, an ABP provided herein comprises one or more alterations that improves or diminishes C1q binding and/or CDC. See U.S. Pat. No. 6,194,551; WO 99/51642; and Idusogie et al., *J. Immunol.*, 2000, 164:4178-4184; each of which is incorporated by reference in its entirety.

In some embodiments, an ABP provided herein comprises one or more alterations to increase half-life. ABPs with increased half-lives and improved binding to the neonatal Fc receptor (FcRn) are described, for example, in Hinton et al., *J. Immunol.*, 2006, 176:346-356; and U.S. Pat. Pub. No. 2005/0014934; each of which is incorporated by reference in its entirety. Such Fc variants include those with substitutions at one or more of Fc region residues: 238, 250, 256, 265, 272, 286, 303, 305, 307, 311, 312, 314, 317, 340, 356, 360, 362, 376, 378, 380, 382, 413, 424, 428, and 434 of an IgG.

In some embodiments, an ABP provided herein comprises one or more Fc region variants as described in U.S. Pat. Nos. 7,371,826, 5,648,260, and 5,624,821; Duncan and Winter, *Nature*, 1988, 322:738-740; and WO 94/29351; each of which is incorporated by reference in its entirety.

1.7. Cysteine Engineered Antigen-Binding Protein Variants

In certain embodiments, provided herein are cysteine engineered ABPs, also known as "thioMAbs," in which one or more residues of the ABP are substituted with cysteine residues. In particular embodiments, the substituted residues occur at solvent accessible sites of the ABP. By substituting such residues with cysteine, reactive thiol groups are introduced at solvent accessible sites of the ABP and may be used to conjugate the ABP to other moieties, such as drug moieties or linker-drug moieties, for example, to create an immunoconjugate.

In certain embodiments, any one or more of the following residues may be substituted with cysteine: V205 of the light chain; A118 of the heavy chain Fc region; and S400 of the heavy chain Fc region. Cysteine engineered ABPs may be generated as described, for example, in U.S. Pat. No. 7,521,541, which is incorporated by reference in its entirety.

1.7.1. Immunoconjugates

1.7.1.1. Antigen-Binding Protein-Polymer Conjugates

In some embodiments, an ABP provided herein is derivatized by conjugation with a polymer. Any suitable polymer may be conjugated to the ABP.

In some embodiments, the polymer is a water soluble polymer. Illustrative examples of water soluble polymers include polyethylene glycol (PEG), copolymers of ethylene glycol/propylene glycol, carboxymethylcellulose, dextran, polyvinyl alcohol, polyvinyl pyrrolidone, poly-1,3-dioxolane, poly-1,3,6-trioxane, ethylene/maleic anhydride copolymer, polyaminoacids (either homopolymers or random copolymers), poly(n-vinyl pyrrolidone)-co-polyethylene glycol, propropylene glycol homopolymers, polypropylene oxide/ethylene oxide co-polymers, polyoxyethylated polyols (e.g., glycerol), polyvinyl alcohol, and mixtures thereof. In some aspects, polyethylene glycol propionaldehyde may have advantages in manufacturing due to its stability in water.

The polymer may be of any molecular weight, and may be branched or unbranched. The number of polymers attached to each ABP may vary, and if more than one polymer is attached, they may be the same polymer or different polymers. In general, the number and/or type of polymers used for derivatization can be determined based on considerations including the particular properties or functions of the ABP to be improved and the intended use of the ABP.

1.7.1.2. Antigen-Binding Protein-Drug Conjugates

In some embodiments, the ABPs provided herein are conjugated to one or more therapeutic agents. Any suitable therapeutic agent may be conjugated to the ABP. Exemplary therapeutic agents include cytokines, chemokines, and other agents that induce a desired T cell activity, such as GITRL, OX40L, 4-1BBL, TNF-alpha, IL-2, IL-15 fusion, CXCL9, CXCL10, IL-10 trap, IL-27 trap, and IL-35 trap. Cytokine traps and their use are known in the art and described, for example, in Economides et al., *Nature Medicine,* 2003, 9:47-52, incorporated by reference in its entirety.

Methods of Making GITR Antigen-Binding Proteins 1.8. GITR Antigen Preparation

The GITR antigen used for isolation of the ABPs provided herein may be intact GITR or a fragment of GITR. The GITR antigen may be in the form of an isolated protein or a protein expressed on the surface of a cell.

In some embodiments, the GITR antigen is a non-naturally occurring variant of GITR, such as a GITR protein having an amino acid sequence or post-translational modification that does not occur in nature.

In some embodiments, the GITR antigen is truncated by removal of, for example, intracellular or membrane-spanning sequences, or signal sequences. In some embodiments, the GITR antigen is fused at its C-terminus to a human IgG1 Fc domain or a polyhistidine tag.

1.9. Methods of Making Monoclonal Antibodies

Monoclonal antibodies may be obtained, for example, using the hybridoma method first described by Kohler et al., *Nature,* 1975, 256:495-497 (incorporated by reference in its entirety), and/or by recombinant DNA methods (see e.g., U.S. Pat. No. 4,816,567, incorporated by reference in its entirety). Monoclonal antibodies may also be obtained, for example, using phage or yeast-based libraries. See e.g., U.S. Pat. Nos. 8,258,082 and 8,691,730, each of which is incorporated by reference in its entirety.

In the hybridoma method, a mouse or other appropriate host animal is immunized to elicit lymphocytes that produce or are capable of producing antibodies that will specifically bind to the protein used for immunization. Alternatively, lymphocytes may be immunized in vitro. Lymphocytes are then fused with myeloma cells using a suitable fusing agent, such as polyethylene glycol, to form a hybridoma cell. See Goding J. W., *Monoclonal Antibodies: Principles and Practice* $3^{rd}$ ed. (1986) Academic Press, San Diego, Calif., incorporated by reference in its entirety.

The hybridoma cells are seeded and grown in a suitable culture medium that contains one or more substances that inhibit the growth or survival of the unfused, parental myeloma cells. For example, if the parental myeloma cells lack the enzyme hypoxanthine guanine phosphoribosyl transferase (HGPRT or HPRT), the culture medium for the hybridomas typically will include hypoxanthine, aminopterin, and thymidine (HAT medium), which substances prevent the growth of HGPRT-deficient cells.

Useful myeloma cells are those that fuse efficiently, support stable high-level production of antibody by the selected antibody-producing cells, and are sensitive media conditions, such as the presence or absence of HAT medium. Among these, preferred myeloma cell lines are murine myeloma lines, such as those derived from MOP-21 and MC-11 mouse tumors (available from the Salk Institute Cell Distribution Center, San Diego, Calif.), and SP-2 or X63-Ag8-653 cells (available from the American Type Culture Collection, Rockville, Md.). Human myeloma and mouse-human heteromyeloma cell lines also have been described for the production of human monoclonal antibodies. See e.g., Kozbor, *J. Immunol.,* 1984, 133:3001, incorporated by reference in its entirety.

After the identification of hybridoma cells that produce antibodies of the desired specificity, affinity, and/or biological activity, selected clones may be subcloned by limiting dilution procedures and grown by standard methods. See Goding, supra. Suitable culture media for this purpose include, for example, D-MEM or RPMI-1640 medium. In addition, the hybridoma cells may be grown in vivo as ascites tumors in an animal.

DNA encoding the monoclonal antibodies may be readily isolated and sequenced using conventional procedures (e.g., by using oligonucleotide probes that are capable of binding specifically to genes encoding the heavy and light chains of the monoclonal antibodies). Thus, the hybridoma cells can serve as a useful source of DNA encoding antibodies with the desired properties. Once isolated, the DNA may be placed into expression vectors, which are then transfected into host cells such as bacteria (e.g., *E. coli*), yeast (e.g., *Saccharomyces* or *Pichia* sp.), COS cells, Chinese hamster ovary (CHO) cells, or myeloma cells that do not otherwise produce antibody, to produce the monoclonal antibodies.

1.10. Methods of Making Chimeric Antibodies

Illustrative methods of making chimeric antibodies are described, for example, in U.S. Pat. No. 4,816,567; and Morrison et al., *Proc. Natl. Acad. Sci. USA,* 1984, 81:6851-6855; each of which is incorporated by reference in its entirety. In some embodiments, a chimeric antibody is made by using recombinant techniques to combine a non-human variable region (e.g., a variable region derived from a mouse, rat, hamster, rabbit, or non-human primate, such as a monkey) with a human constant region.

1.11. Methods of Making Humanized Antibodies

Humanized antibodies may be generated by replacing most, or all, of the structural portions of a non-human monoclonal antibody with corresponding human antibody sequences. Consequently, a hybrid molecule is generated in which only the antigen-specific variable, or CDR, is composed of non-human sequence. *Methods* to obtain humanized antibodies include those described in, for example, Winter and Milstein, *Nature,* 1991, 349:293-299; Rader et al., *Proc. Nat. Acad. Sci. USA.,* 1998, 95:8910-8915; Steinberger et al., *J. Biol. Chem.,* 2000, 275:36073-36078; Queen et al., *Proc. Natl. Acad. Sci. USA.,* 1989, 86:10029-10033; and U.S. Pat. Nos. 5,585,089, 5,693,761, 5,693,762, and 6,180,370; each of which is incorporated by reference in its entirety.

1.12. Methods of making Human Antibodies

Human antibodies can be generated by a variety of techniques known in the art, for example by using transgenic animals (e.g., humanized mice). See, e.g., Jakobovits et al., *Proc. Natl. Acad. Sci. USA.,* 1993, 90:2551; Jakobovits et al., *Nature,* 1993, 362:255-258; Bruggermann et al., *Year in Immuno.,* 1993, 7:33; and U.S. Pat. Nos. 5,591,669, 5,589,369 and 5,545,807; each of which is incorporated by reference in its entirety. Human antibodies can also be derived from phage-display libraries (see e.g., Hoogenboom et al., *J. Mol. Biol.,* 1991, 227:381-388; Marks et al., *J. Mol. Biol.,* 1991, 222:581-597; and U.S. Pat. Nos. 5,565,332 and 5,573,905; each of which is incorporated by reference in its entirety). Human antibodies may also be generated by in vitro activated B cells (see e.g., U.S. Pat. Nos. 5,567,610 and 5,229,275, each of which is incorporated by reference in its entirety). Human antibodies may also be derived from yeast-based libraries (see e.g., U.S. Pat. No. 8,691,730, incorporated by reference in its entirety).

1.13. Methods of Making Antibody Fragments

The antibody fragments provided herein may be made by any suitable method, including the illustrative methods described herein or those known in the art. Suitable methods include recombinant techniques and proteolytic digestion of whole antibodies. Illustrative methods of making antibody fragments are described, for example, in Hudson et al., *Nat. Med.*, 2003, 9:129-134, incorporated by reference in its entirety. Methods of making scFv antibodies are described, for example, in Plückthun, in *The Pharmacology of Monoclonal Antibodies*, vol. 113, Rosenburg and Moore eds., Springer-Verlag, New York, pp. 269-315 (1994); WO 93/16185; and U.S. Pat. Nos. 5,571,894 and 5,587,458; each of which is incorporated by reference in its entirety.

1.14. Methods of Making Alternative Scaffolds

The alternative scaffolds provided herein may be made by any suitable method, including the illustrative methods described herein or those known in the art. For example, methods of preparing Adnectins™ are described in Emanuel et al., *mAbs*, 2011, 3:38-48, incorporated by reference in its entirety. Methods of preparing iMabs are described in U.S. Pat. Pub. No. 2003/0215914, incorporated by reference in its entirety. Methods of preparing Anticalins® are described in Vogt and Skerra, *Chem. Biochem.*, 2004, 5:191-199, incorporated by reference in its entirety. Methods of preparing Kunitz domains are described in Wagner et al., *Biochem. & Biophys. Res. Comm.*, 1992, 186:118-1145, incorporated by reference in its entirety. Methods of preparing thioredoxin peptide aptamers are provided in Geyer and Brent, *Meth. Enzymol.*, 2000, 328:171-208, incorporated by reference in its entirety. Methods of preparing Affibodies are provided in Fernandez, *Curr. Opinion in Biotech.*, 2004, 15:364-373, incorporated by reference in its entirety. Methods of preparing DARPins are provided in Zahnd et al., *J. Mol. Biol.*, 2007, 369:1015-1028, incorporated by reference in its entirety. Methods of preparing Affilins are provided in Ebersbach et al., *J. Mol. Biol.*, 2007, 372:172-185, incorporated by reference in its entirety. Methods of preparing Tetranectins are provided in Graversen et al., *J. Biol. Chem.*, 2000, 275:37390-37396, incorporated by reference in its entirety. Methods of preparing Avimers are provided in Silverman et al., *Nature Biotech.*, 2005, 23:1556-1561, incorporated by reference in its entirety. Methods of preparing Fynomers are provided in Silacci et al., *J. Biol. Chem.*, 2014, 289:14392-14398, incorporated by reference in its entirety.

Further information on alternative scaffolds is provided in Binz et al., *Nat. Biotechnol.*, 2005 23:1257-1268; and Skerra, *Current Opin. in Biotech.*, 2007 18:295-304, each of which is incorporated by reference in its entirety.

1.15. Methods of Making Multispecific ABPs

The multispecific or multivalent monospecific ABPs provided herein may be made by any suitable method, including the illustrative methods described herein or those known in the art. Methods of making common light chain antibodies are described in Merchant et al., *Nature Biotechnol.*, 1998, 16:677-681, incorporated by reference in its entirety. Methods of making tetravalent bispecific antibodies are described in Coloma and Morrison, *Nature Biotechnol.*, 1997, 15:159-163, incorporated by reference in its entirety. Methods of making hybrid immunoglobulins are described in Milstein and Cuello, *Nature*, 1983, 305:537-540; and Staerz and Bevan, *Proc. Natl. Acad. Sci. USA*, 1986, 83:1453-1457; each of which is incorporated by reference in its entirety. Methods of making immunoglobulins with knobs-into-holes modification are described in U.S. Pat. No. 5,731,168, incorporated by reference in its entirety. Methods of making immunoglobulins with electrostatic modifications are provided in WO 2009/089004, incorporated by reference in its entirety. Methods of making multivalent (e.g., tetravalent) monospecific antibodies are described in Miller et al., 2003, U.S. Pat. No. 8,722,859, incorporated by reference in its entirety. Methods of making bispecific single chain antibodies are described in Traunecker et al., *EMBO J.*, 1991, 10:3655-3659; and Gruber et al., *J. Immunol.*, 1994, 152: 5368-5374; each of which is incorporated by reference in its entirety. Methods of making single-chain antibodies, whose linker length may be varied, are described in U.S. Pat. Nos. 4,946,778 and 5,132,405, each of which is incorporated by reference in its entirety. Methods of making diabodies are described in Hollinger et al., *Proc. Natl. Acad. Sci. USA*, 1993, 90:6444-6448, incorporated by reference in its entirety. Methods of making triabodies and tetrabodies are described in Todorovska et al., *J. Immunol. Methods*, 2001, 248:47-66, incorporated by reference in its entirety. Methods of making trispecific F(ab')3 derivatives are described in Tutt et al. *J. Immunol.*, 1991, 147:60-69, incorporated by reference in its entirety. Methods of making cross-linked antibodies are described in U.S. Pat. No. 4,676,980; Brennan et al., *Science*, 1985, 229:81-83; Staerz, et al. *Nature*, 1985, 314:628-631; and EP 0453082; each of which is incorporated by reference in its entirety. Methods of making antigen-binding domains assembled by leucine zippers are described in Kostelny et al., *J. Immunol.*, 1992, 148:1547-1553, incorporated by reference in its entirety. Methods of making ABPs via the DNL approach are described in U.S. Pat. Nos. 7,521,056; 7,550,143; 7,534,866; and 7,527,787; each of which is incorporated by reference in its entirety. Methods of making hybrids of antibody and non-antibody molecules are described in WO 93/08829, incorporated by reference in its entirety, for examples of such ABPs. Methods of making DAF antibodies are described in U.S. Pat. Pub. No. 2008/0069820, incorporated by reference in its entirety. Methods of making ABPs via reduction and oxidation are described in Carlring et al., *PLoS One*, 2011, 6:e22533, incorporated by reference in its entirety. Methods of making DVD-Igs™ are described in U.S. Pat. No. 7,612, 181, incorporated by reference in its entirety. Methods of making DARTs™ are described in Moore et al., *Blood*, 2011, 117:454-451, incorporated by reference in its entirety. Methods of making DuoBodies® are described in Labrijn et al., *Proc. Natl. Acad. Sci. USA*, 2013, 110:5145-5150; Gramer et al., *mAbs*, 2013, 5:962-972; and Labrijn et al., *Nature Protocols*, 2014, 9:2450-2463; each of which is incorporated by reference in its entirety. Methods of making antibodies comprising scFvs fused to the C-terminus of the $C_{H3}$ from an IgG are described in Coloma and Morrison, *Nature Biotechnol.*, 1997, 15:159-163, incorporated by reference in its entirety. Methods of making antibodies in which a Fab molecule is attached to the constant region of an immunoglobulin are described in Miler et al., *J. Immunol.*, 2003, 170:4854-4861, incorporated by reference in its entirety. Methods of making CovX-Bodies are described in Doppalapudi et al., *Proc. Natl. Acad. Sci. USA*, 2010, 107:22611-22616, incorporated by reference in its entirety. Methods of making Fcab antibodies are described in Wozniak-Knopp et al., *Protein Eng. Des. Sel.*, 2010, 23:289-297, incorporated by reference in its entirety. Methods of making TandAb® antibodies are described in Kipriyanov et al., *J. Mol. Biol.*, 1999, 293:41-56 and Zhukovsky et al., *Blood*, 2013, 122:5116, each of which is incorporated by reference in its entirety. Methods of making tandem Fabs are described in WO 2015/103072, incorporated by reference in its entirety. Methods of making Zybodies™ are described in LaFleur et al., *mAbs*, 2013, 5:208-218, incorporated by reference in its entirety.

In another aspect is provided a method for producing an anti-human GITR antibody or an antigen-binding fragment thereof, comprising culturing host cell(s) selected from the group consisting of (a) to (c) below to express a tetravalent anti-human GITR antibody or an antigen-binding fragment thereof: (a) a host cell transformed with an expression vector comprising a polynucleotide comprising a base sequence encoding the heavy chain variable region of the anti-human GITR antibody or the antigen-binding fragment thereof provided herein and a polynucleotide comprising a base sequence encoding the light chain variable region of the antibody or the antigen-binding fragment thereof; (b) a host cell transformed with an expression vector comprising a polynucleotide comprising a base sequence encoding the heavy chain variable region of the anti-human GITR antibody or the antigen-binding fragment thereof provided herein and an expression vector comprising a polynucleotide comprising a base sequence encoding the light chain variable region of the antibody or the antigen-binding fragment thereof; and (c) a host cell transformed with an expression vector comprising a polynucleotide comprising a base sequence encoding the heavy chain variable region of the anti-human GITR antibody or the antigen-binding fragment thereof provided herein and a host cell transformed with an expression vector comprising a polynucleotide comprising a base sequence encoding the light chain variable region of the antibody or the antigen-binding fragment thereof.

In another aspect is provided a method for producing an anti-human GITR antibody, comprising culturing host cell(s) selected from the group consisting of (a) to (c) below to express an anti-human GITR antibody: (a) a host cell transformed with an expression vector comprising a polynucleotide comprising a base sequence encoding the heavy chain of the anti-human GITR antibody provided herein and a polynucleotide comprising a base sequence encoding the light chain of the antibody; (b) a host cell transformed with an expression vector comprising a polynucleotide comprising a base sequence encoding the heavy chain of the anti-human GITR antibody provided herein and an expression vector comprising a polynucleotide comprising a base sequence encoding the light chain of the antibody; and (c) a host cell transformed with an expression vector comprising a polynucleotide comprising a base sequence encoding the heavy chain of the anti-human GITR antibody provided herein and a host cell transformed with an expression vector comprising a polynucleotide comprising a base sequence encoding the light chain of the antibody.

1.16. Methods of Making Variants

In some embodiments, an ABP provided herein is an affinity matured variant of a parent ABP, which may be generated, for example, using phage display-based affinity maturation techniques. Briefly, one or more CDR residues may be mutated and the variant ABPs, or portions thereof, displayed on phage and screened for affinity. Such alterations may be made in CDR "hotspots," or residues encoded by codons that undergo mutation at high frequency during the somatic maturation process (see Chowdhury, *Methods Mol. Biol.*, 2008, 207:179-196, incorporated by reference in its entirety), and/or residues that contact the antigen. In some embodiments, affinity maturation can be used for altering or introducing species binding, i.e., an anti-mouse antibody may be engineered to bind to human and cynomolgus monkey versions of the same target antigen, etc.

Any suitable method can be used to introduce variability into a polynucleotide sequence(s) encoding an ABP, including error-prone PCR, chain shuffling, and oligonucleotide-directed mutagenesis such as trinucleotide-directed mutagenesis (TRIM). In some aspects, several CDR residues (e.g., 4-6 residues at a time) are randomized. CDR residues involved in antigen binding may be specifically identified, for example, using alanine scanning mutagenesis or modeling. CDR-H3 and CDR-L3 in particular are often targeted for mutation.

The introduction of diversity into the variable regions and/or CDRs can be used to produce a secondary library. The secondary library is then screened to identify ABP variants with improved affinity. Affinity maturation by constructing and reselecting from secondary libraries has been described, for example, in Hoogenboom et al., *Methods in Molecular Biology*, 2001, 178:1-37, incorporated by reference in its entirety.

1.17. Vectors, Host Cells, and Recombinant Methods

Also provided are isolated nucleic acids encoding GITR ABPs, vectors comprising the nucleic acids, and host cells comprising the vectors and nucleic acids, as well as recombinant techniques for the production of the ABPs.

In another aspect is provided a polynucleotide comprising a base sequence encoding the heavy chain variable region of the anti-human GITR antibody or the antigen-binding fragment thereof provided herein. In another aspect is provided a polynucleotide comprising a base sequence encoding the light chain variable region of the anti-human GTIR antibody or the antigen-binding fragment thereof provided herein.

In another aspect is provided a polynucleotide comprising a base sequence encoding the heavy chain of the anti-human GITR antibody provided herein. In another aspect is provided a polynucleotide comprising a base sequence encoding the light chain of the anti-human GTIR antibody provided herein.

For recombinant production of an ABP, the nucleic acid(s) encoding it may be isolated and inserted into a replicable vector for further cloning (i.e., amplification of the DNA) or expression. In some aspects, the nucleic acid may be produced by homologous recombination, for example as described in U.S. Pat. No. 5,204,244, incorporated by reference in its entirety.

In another aspect is provided an expression vector comprising (a) a polynucleotide comprising a base sequence encoding the heavy chain variable region of the anti-human GITR antibody or the antigen-binding fragment thereof provided herein and/or (b) a polynucleotide comprising a base sequence encoding the light chain variable region of the anti-human GITR antibody or the antigen-binding fragment thereof.

In another aspect is provided an expression vector comprising (a) a polynucleotide comprising a base sequence encoding the heavy chain of the anti-human GITR antibody provided herein and/or (b) a polynucleotide comprising a base sequence encoding the light chain of the anti-human GITR antibody.

Many different vectors are known in the art. The vector components generally include one or more of the following: a signal sequence, an origin of replication, one or more marker genes, an enhancer element, a promoter, and a transcription termination sequence, for example as described in U.S. Pat. No. 5,534,615, incorporated by reference in its entirety.

Illustrative examples of suitable host cells are provided below. These host cells are not meant to be limiting, and any suitable host cell may be used to produce the ABPs provided herein.

In another aspect is provided a host cell transformed with an expression vector selected from the group consisting of (a) to (d): (a) a host cell transformed with an expression vector comprising a polynucleotide comprising a base sequence encoding the heavy chain variable region of the anti-human GITR antibody or the antigen-binding fragment thereof provided herein, and a polynucleotide comprising a base sequence encoding the light chain variable region of the antibody or the antigen-binding fragment thereof; (b) a host cell transformed with an expression vector comprising a polynucleotide comprising a base sequence encoding the heavy chain variable region of the anti-human GITR antibody or the antigen-biding fragment thereof provided herein and an expression vector comprising a polynucleotide comprising a base sequence encoding the light chain variable region of the antibody or the antigen-binding fragment thereof; (c) a host cell transformed with an expression vector comprising a polynucleotide comprising a base sequence encoding the heavy chain variable region of the anti-human GITR antibody or the antigen-binding fragment thereof provided herein; and (d) a host cell transformed with an expression vector comprising a polynucleotide comprising a base sequence encoding the light chain variable region of the anti-human GITR antibody or the antigen-binding fragment thereof provided herein.

In another aspect is provided host cell transformed with an expression vector selected from the group consisting of (a) to (d): (a) a host cell transformed with an expression vector comprising a polynucleotide comprising a base sequence encoding the heavy chain of the anti-human GITR antibody provided herein and a polynucleotide comprising a base sequence encoding the light chain of the antibody; (b) a host cell transformed with an expression vector comprising a polynucleotide comprising a base sequence encoding the heavy chain of the anti-human GITR antibody provided herein and an expression vector comprising a polynucleotide comprising a polynucleotide comprising the light chain of the antibody; (c) a host cell transformed with an expression vector comprising a polynucleotide comprising a base sequence encoding the heavy chain of the anti-human GITR antibody provided herein; and (d) a host cell transformed with an expression vector comprising a polynucleotide comprising a base sequence encoding the light chain of the anti-human GITR antibody provided herein.

Suitable host cells include any prokaryotic (e.g., bacterial), lower eukaryotic (e.g., yeast), or higher eukaryotic (e.g., mammalian) cells. Suitable prokaryotes include eubacteria, such as Gram-negative or Gram-positive organisms, for example, Enterobacteriaceae such as *Escherichia* (*E. coli*), *Enterobacter*, *Erwinia*, *Klebsiella*, *Proteus*, *Salmonella* (*S. typhimurium*), *Serratia* (*S. marcescans*), *Shigella*, Bacilli (*B. subtilis* and *B. licheniformis*), *Pseudomonas* (*P. aeruginosa*), and *Streptomyces*. One useful *E. coli* cloning host is *E. coli* 294, although other strains such as *E. coli* B, *E. coli* X1776, and *E. coli* W3110 are also suitable.

In addition to prokaryotes, eukaryotic microbes such as filamentous fungi or yeast are also suitable cloning or expression hosts for GITR ABP-encoding vectors. *Saccharomyces cerevisiae*, or common baker's yeast, is a commonly used lower eukaryotic host microorganism. However, a number of other genera, species, and strains are available and useful, such as *Schizosaccharomyces pombe*, *Kluyveromyces* (*K. lactis*, *K. fragilis*, *K. bulgaricus K. wickeramii*, *K. waltii*, *K. drosophilarum*, *K. thermotolerans*, and *K. marxianus*), *Yarrowia*, *Pichia pastoris*, *Candida* (*C. albicans*), *Trichoderma reesia*, *Neurospora crassa*, *Schwanniomyces* (*S. occidentalis*), and filamentous fungi such as, for example *Penicillium*, *Tolypocladium*, and *Aspergillus* (*A. nidulans* and *A. niger*).

Useful mammalian host cells include COS-7 cells, HEK293 cells; baby hamster kidney (BHK) cells; Chinese hamster ovary (CHO); mouse sertoli cells; African green monkey kidney cells (VERO-76), and the like.

The host cells used to produce the GITR ABP of this invention may be cultured in a variety of media. Commercially available media such as, for example, Ham's F10, Minimal Essential Medium (MEM), RPMI-1640, and Dulbecco's Modified Eagle's Medium (DMEM) are suitable for culturing the host cells. In addition, any of the media described in Ham et al., *Meth. Enz.*, 1979, 58:44; Barnes et al., *Anal. Biochem.*, 1980, 102:255; and U.S. Pat. Nos. 4,767,704, 4,657,866, 4,927,762, 4,560,655, and 5,122,469; or WO 90/03430 and WO 87/00195 may be used. Each of the foregoing references is incorporated by reference in its entirety.

Any of these media may be supplemented as necessary with hormones and/or other growth factors (such as insulin, transferrin, or epidermal growth factor), salts (such as sodium chloride, calcium, magnesium, and phosphate), buffers (such as HEPES), nucleotides (such as adenosine and thymidine), antibiotics, trace elements (defined as inorganic compounds usually present at final concentrations in the micromolar range), and glucose or an equivalent energy source. Any other necessary supplements may also be included at appropriate concentrations that would be known to those skilled in the art.

The culture conditions, such as temperature, pH, and the like, are those previously used with the host cell selected for expression, and will be apparent to the ordinarily skilled artisan.

When using recombinant techniques, the ABP can be produced intracellularly, in the periplasmic space, or directly secreted into the medium. If the ABP is produced intracellularly, as a first step, the particulate debris, either host cells or lysed fragments, is removed, for example, by centrifugation or ultrafiltration. For example, Carter et al. (*Bio/Technology*, 1992, 10:163-167, incorporated by reference in its entirety) describes a procedure for isolating ABPs which are secreted to the periplasmic space of *E. coli*. Briefly, cell paste is thawed in the presence of sodium acetate (pH 3.5), EDTA, and phenylmethylsulfonylfluoride (PMSF) over about 30 min. Cell debris can be removed by centrifugation.

In some embodiments, the ABP is produced in a cell-free system. In some aspects, the cell-free system is an in vitro transcription and translation system as described in Yin et al., *mAbs*, 2012, 4:217-225, incorporated by reference in its entirety. In some aspects, the cell-free system utilizes a cell-free extract from a eukaryotic cell or from a prokaryotic cell. In some aspects, the prokaryotic cell is *E. coli*. Cell-free expression of the ABP may be useful, for example, where the ABP accumulates in a cell as an insoluble aggregate, or where yields from periplasmic expression are low.

Where the ABP is secreted into the medium, supernatants from such expression systems are generally first concentrated using a commercially available protein concentration filter, for example, an Amicon® or Millipore® Pellcon® ultrafiltration unit. A protease inhibitor such as PMSF may be included in any of the foregoing steps to inhibit proteolysis and antibiotics may be included to prevent the growth of adventitious contaminants.

The ABP composition prepared from the cells can be purified using, for example, hydroxylapatite chromatography, gel electrophoresis, dialysis, and affinity chromatography, with affinity chromatography being a particularly useful purification technique. The suitability of protein A as an affinity ligand depends on the species and isotype of any immunoglobulin Fc domain that is present in the ABP. Protein A can be used to purify ABPs that comprise human γ1, γ2, or γ4 heavy chains (Lindmark et al., *J. Immunol. Meth.*, 1983, 62:1-13, incorporated by reference in its entirety). Protein G is useful for all mouse isotypes and for human γ3 (Guss et al., *EMBO J.*, 1986, 5:1567-1575, incorporated by reference in its entirety).

The matrix to which the affinity ligand is attached is most often agarose, but other matrices are available. Mechanically stable matrices such as controlled pore glass or poly(styrenedivinyl)benzene allow for faster flow rates and shorter processing times than can be achieved with agarose. Where the ABP comprises a $C_{H3}$ domain, the BakerBond ABX® resin is useful for purification.

Other techniques for protein purification, such as fractionation on an ion-exchange column, ethanol precipitation, Reverse Phase HPLC, chromatography on silica, chromatography on heparin Sepharose®, chromatofocusing, SDS-PAGE, and ammonium sulfate precipitation are also available, and can be applied by one of skill in the art.

Following any preliminary purification step(s), the mixture comprising the ABP of interest and contaminants may be subjected to low pH hydrophobic interaction chromatography using an elution buffer at a pH between about 2.5 to about 4.5, generally performed at low salt concentrations (e.g., from about 0 to about 0.25 M salt).

Assays

A variety of assays known in the art may be used to identify and characterize the GITR ABPs provided herein.

1.18. Binding, Competition, and Epitope Mapping Assays

Specific antigen-binding activity of the ABPs provided herein may be evaluated by any suitable method, including using SPR, BLI, and RIA, as described elsewhere in this disclosure. Additionally, antigen-binding activity may be evaluated by ELISA assays and Western blot assays.

Assays for measuring competition between two ABPs, or an ABP and another molecule (e.g., GITRL) are described elsewhere in this disclosure and, for example, in Harlow and Lane, *Antibodies: A Laboratory Manual* ch. 14, 1988, Cold Spring Harbor Laboratory, Cold Spring Harbor, N.Y., incorporated by reference in its entirety.

Assays for mapping the epitopes to which the ABPs provided herein bind are described, for example, in Morris "Epitope Mapping Protocols," in *Methods in Molecular Biology* vol. 66, 1996, Humana Press, Totowa, N.J., incorporated by reference in its entirety. In some embodiments, the epitope is determined by peptide competition. In some embodiments, the epitope is determined by mass spectrometry. In some embodiments, the epitope is determined by crystallography.

1.19. GITR Agonism Assays

In some embodiments, the ABPs provided herein are screened to identify or characterize ABPs with agonistic activity against GITR. Any suitable assay may be used to identify or characterize such ABPs. In some aspects, the assay measures the amount of a cytokine secreted by an effector T cell after contacting the effector T cell with an ABP provided herein. In some aspects, the cytokine is selected from IL-2Rα, IL-2, IL-8, IFNγ, and combinations thereof. In some aspects, the cytokine is selected from sCD40L, VEGF, TNF-β, TNF-α, TGF-α, RANTES, PDGF-AB/BB, PDGF-AA, MIP-1β, MIP-1α, MDC (CCL22), MCP-3, MCP-1, IP-10, IL-17A, IL-15, IL-13, IL-12 (p70), IL-12 (p40), IL-10, IL-9, IL-8, IL-7, IL-6, IL-5, IL-4, IL-3, IL-2, IL-2Rα, IL-1RA, IL-1β, IL-1α, IFNγ, IFNα2, GRO, GM-CSF, G-CSF, fractalkine, Flt-3 ligand, FGF-2, eotaxin, EGF, and combinations thereof.

In some embodiments, the effector cells are co-stimulated with an agonist of CD3, to promote the secretion of cytokines by the effector cell. In some aspects, the CD3 agonist is provided at a submaximal level.

In some embodiments, functional assays are used such as the HT1080 or Jurkat cell-based assays described in more detail in Example 2. Additional assays are described in Wyzgol et al., *J Immunol* 2009; 183:1851-1861, incorporated herein by reference.

In some aspects, such assays may measure the proliferation of an effector T cell after contacting the effector T cell with an ABP provided herein. In some aspects, proliferation of the effector T cell is measured by dilution of a dye (e.g., carboxyfluorescein diacetate succinimidyl ester; CFSE), by tritiated thymidine uptake, by luminescent cell viability assays, or by other assays known in the art.

In some aspects, such assays may measure the differentiation, cytokine production, viability (e.g., survival), proliferation, or suppressive activity of a regulatory T cell after contacting the regulatory T cell with an ABP provided herein.

In some aspects, such assays may measure the cytotoxic activity of an NK cell after contacting the NK cell with an ABP provided herein. In some aspects, the cytotoxic activity of the NK cell is measured using a cytotoxicity assay that quantifies NK-mediated killing of target cells (e.g., a K562 cell line). See Jang et al., *Ann. Clin. Lab. Sci.*, 2012, 42:42-49, incorporated by reference in its entirety.

Additional assays for measuring GITR agonism are described elsewhere in this disclosure, including in the Examples, and known in the art. A skilled person can readily select an appropriate assay for evaluating GITR agonism.

1.20. Assays for Effector Functions

Effector function of the ABPs provided herein may be evaluated using a variety of in vitro and in vivo assays known in the art, including those described in Ravetch and Kinet, *Annu. Rev. Immunol.*, 1991, 9:457-492; U.S. Pat. Nos. 5,500,362, 5,821,337; Hellstrom et al., *Proc. Nat'l Acad. Sci. USA*, 1986, 83:7059-7063; Hellstrom et al., *Proc. Nat'l Acad. Sci. USA*, 1985, 82:1499-1502; Bruggemann et al., *J. Exp. Med.*, 1987, 166:1351-1361; Clynes et al., *Proc. Nat'l Acad. Sci. USA*, 1998, 95:652-656; WO 2006/029879; WO 2005/100402; Gazzano-Santoro et al., *J. Immunol. Methods*, 1996, 202:163-171; Cragg et al., *Blood*, 2003, 101:1045-1052; Cragg et al. *Blood*, 2004, 103:2738-2743; and Petkova et al., *Int'l. Immunol.*, 2006, 18:1759-1769; each of which is incorporated by reference in its entirety.

Pharmaceutical Compositions

The ABPs provided herein can be formulated in any appropriate pharmaceutical composition and administered by any suitable route of administration. Suitable routes of administration include, but are not limited to, the intraarterial, intradermal, intramuscular, intraperitoneal, intravenous, nasal, parenteral, pulmonary, and subcutaneous routes.

In another aspect is provided a pharmaceutical composition comprising plural kinds of anti-human GITR antibodies or antigen-binding fragments thereof provided herein. For example, the pharmaceutical composition comprises an antibody or an antigen-binding fragment thereof, which does not undergo posttranslational modification and an antibody or an antigen-binding fragment thereof derived from posttranslational modification of the antibody or the antigen-binding fragment thereof.

In one embodiment, the pharmaceutical composition comprises at least two kinds of anti-human GITR antibodies selected from (1) to (4): (1) an anti-human GITR antibody comprises two heavy chains consisting of SEQ ID NO: 7 and four light chains consisting of SEQ ID NO: 8; (2) an anti-human GITR antibody comprises two heavy chains consisting of SEQ ID NO: 7, wherein the Q at position 1 is modified to pyroglutamate and four light chains consisting of SEQ ID NO: 8; (3) an anti-human GITR antibody comprises two heavy chains consisting of the amino acid sequence ranging from Q at position 1 to G at position 686 of SEQ ID NO: 7, and four light chains consisting of SEQ ID NO: 8; and (4) an anti-human GITR antibody comprises two heavy chains consisting of the amino acid sequence ranging from Q at position 1 to G at position 686 of SEQ ID NO: 7, wherein the Q at position 1 is modified to pyroglutamate and four light chains of SEQ ID NO: 8.

In one embodiment, the pharmaceutical composition comprises an anti-human GITR antibody comprises two heavy chains consisting of SEQ ID NO: 7 and four light chains consisting of SEQ ID NO: 8; and an anti-human GITR antibody comprises two heavy chains consisting of the amino acid sequence ranging from Q at position 1 to G at position 686 of SEQ ID NO: 7, wherein the Q at position 1 is modified to pyroglutamate and four light chains of SEQ ID NO: 8, and a pharmaceutically acceptable excipient.

The pharmaceutical composition may comprise one or more pharmaceutical excipients. Any suitable pharmaceutical excipient may be used, and one of ordinary skill in the art is capable of selecting suitable pharmaceutical excipients. Accordingly, the pharmaceutical excipients provided below are intended to be illustrative, and not limiting. Additional pharmaceutical excipients include, for example, those described in the *Handbook of Pharmaceutical Excipients*, Rowe et al. (Eds.) 6th Ed. (2009), incorporated by reference in its entirety.

In some embodiments, the pharmaceutical composition comprises an anti-foaming agent. Any suitable anti-foaming agent may be used. In some aspects, the anti-foaming agent is selected from an alcohol, an ether, an oil, a wax, a silicone, a surfactant, and combinations thereof. In some aspects, the anti-foaming agent is selected from a mineral oil, a vegetable oil, ethylene bis stearamide, a paraffin wax, an ester wax, a fatty alcohol wax, a long chain fatty alcohol, a fatty acid soap, a fatty acid ester, a silicon glycol, a fluorosilicone, a polyethylene glycol-polypropylene glycol copolymer, polydimethylsiloxane-silicon dioxide, ether, octyl alcohol, capryl alcohol, sorbitan trioleate, ethyl alcohol, 2-ethylhexanol, dimethicone, oleyl alcohol, simethicone, and combinations thereof.

In some embodiments, the pharmaceutical composition comprises a cosolvent. Illustrative examples of cosolvents include ethanol, poly(ethylene) glycol, butylene glycol, dimethylacetamide, glycerin, propylene glycol, and combinations thereof.

In some embodiments, the pharmaceutical composition comprises a buffer. Illustrative examples of buffers include acetate, borate, carbonate, lactate, malate, phosphate, citrate, hydroxide, diethanolamine, monoethanolamine, glycine, methionine, guar gum, monosodium glutamate, and combinations thereof.

In some embodiments, the pharmaceutical composition comprises a carrier or filler. Illustrative examples of carriers or fillers include lactose, maltodextrin, mannitol, sorbitol, chitosan, stearic acid, xanthan gum, guar gum, and combinations thereof.

In some embodiments, the pharmaceutical composition comprises a surfactant. Illustrative examples of surfactants include d-alpha tocopherol, benzalkonium chloride, benzethonium chloride, cetrimide, cetylpyridinium chloride, docusate sodium, glyceryl behenate, glyceryl monooleate, lauric acid, macrogol 15 hydroxystearate, myristyl alcohol, phospholipids, polyoxyethylene alkyl ethers, polyoxyethylene sorbitan fatty acid esters, polyoxyethylene stearates, polyoxylglycerides, sodium lauryl sulfate, sorbitan esters, vitamin E polyethylene(glycol) succinate, and combinations thereof.

In some embodiments, the pharmaceutical composition comprises an anti-caking agent.

Illustrative examples of anti-caking agents include calcium phosphate (tribasic), hydroxymethyl cellulose, hydroxypropyl cellulose, magnesium oxide, and combinations thereof.

Other excipients that may be used with the pharmaceutical compositions include, for example, albumin, antioxidants, antibacterial agents, antifungal agents, bioabsorbable polymers, chelating agents, controlled release agents, diluents, dispersing agents, dissolution enhancers, emulsifying agents, gelling agents, ointment bases, penetration enhancers, preservatives, solubilizing agents, solvents, stabilizing agents, sugars, and combinations thereof. Specific examples of each of these agents are described, for example, in the *Handbook of Pharmaceutical Excipients*, Rowe et al. (Eds.) 6th Ed. (2009), The Pharmaceutical Press, incorporated by reference in its entirety.

In some embodiments, the pharmaceutical composition comprises a solvent. In some aspects, the solvent is saline solution, such as a sterile isotonic saline solution or dextrose solution. In some aspects, the solvent is water for injection.

In some embodiments, the pharmaceutical compositions are in a particulate form, such as a microparticle or a nanoparticle. Microparticles and nanoparticles may be formed from any suitable material, such as a polymer or a lipid. In some aspects, the microparticles or nanoparticles are micelles, liposomes, or polymersomes.

Further provided herein are anhydrous pharmaceutical compositions and dosage forms comprising an ABP, since water can facilitate the degradation of some ABPs.

Anhydrous pharmaceutical compositions and dosage forms provided herein can be prepared using anhydrous or low moisture containing ingredients and low moisture or low humidity conditions. Pharmaceutical compositions and dosage forms that comprise lactose and at least one active ingredient that comprises a primary or secondary amine can be anhydrous if substantial contact with moisture and/or humidity during manufacturing, packaging, and/or storage is expected.

An anhydrous pharmaceutical composition should be prepared and stored such that its anhydrous nature is maintained. Accordingly, anhydrous compositions can be packaged using materials known to prevent exposure to water such that they can be included in suitable formulary kits. Examples of suitable packaging include, but are not limited to, hermetically sealed foils, plastics, unit dose containers (e.g., vials), blister packs, and strip packs.

1.21. Parenteral Dosage Forms

In certain embodiments, the ABPs provided herein are formulated as parenteral dosage forms. Parenteral dosage forms can be administered to subjects by various routes including, but not limited to, subcutaneous, intravenous (including infusions and bolus injections), intramuscular, and intraarterial. Because their administration typically bypasses subjects' natural defenses against contaminants, parenteral dosage forms are typically, sterile or capable of being sterilized prior to administration to a subject. Examples of parenteral dosage forms include, but are not limited to, solutions ready for injection, dry (e.g., lyophilized) products ready to be dissolved or suspended in a pharmaceutically acceptable vehicle for injection, suspensions ready for injection, and emulsions.

Suitable vehicles that can be used to provide parenteral dosage forms are well known to those skilled in the art. Examples include, but are not limited to: Water for Injection USP; aqueous vehicles such as, but not limited to, Sodium Chloride Injection, Ringer's Injection, Dextrose Injection, Dextrose and Sodium Chloride Injection, and Lactated Ringer's Injection; water miscible vehicles such as, but not limited to, ethyl alcohol, polyethylene glycol, and polypropylene glycol; and non-aqueous vehicles such as, but not limited to, corn oil, cottonseed oil, peanut oil, sesame oil, ethyl oleate, isopropyl myristate, and benzyl benzoate.

Excipients that increase the solubility of one or more of the ABPs disclosed herein can also be incorporated into the parenteral dosage forms.

In some embodiments, the parenteral dosage form is lyophilized. Exemplary lyophilized formulations are described, for example, in U.S. Pat. Nos. 6,267,958 and 6,171,586; and WO 2006/044908; each of which is incorporated by reference in its entirety.

Dosage and Unit Dosage Forms

In human therapeutics, the doctor will determine the posology which he considers most appropriate according to a preventive or curative treatment and according to the age, weight, condition and other factors specific to the subject to be treated.

In certain embodiments, a composition provided herein is a pharmaceutical composition or a single unit dosage form. Pharmaceutical compositions and single unit dosage forms provided herein comprise a prophylactically or therapeutically effective amount of one or more prophylactic or therapeutic ABPs.

The amount of the ABP or composition which will be effective in the prevention or treatment of a disorder or one or more symptoms thereof will vary with the nature and severity of the disease or condition, and the route by which the ABP is administered. The frequency and dosage will also vary according to factors specific for each subject depending on the specific therapy (e.g., therapeutic or prophylactic agents) administered, the severity of the disorder, disease, or condition, the route of administration, as well as age, body, weight, response, and the past medical history of the subject. Effective doses may be extrapolated from dose-response curves derived from in vitro or animal model test systems.

In certain embodiments, exemplary doses of a composition include milligram or microgram amounts of the ABP per kilogram of subject or sample weight (e.g., about 100 micrograms per kilogram to about 25 milligrams per kilogram, or about 100 micrograms per kilogram to about 10 milligrams per kilogram). In certain embodiment, the dosage of the ABP provided herein, based on weight of the ABP, administered to prevent, treat, manage, or ameliorate a disorder, or one or more symptoms thereof in a subject is 0.1 mg/kg, 1 mg/kg, 2 mg/kg, 3 mg/kg, 4 mg/kg, 5 mg/kg, 6 mg/kg, 10 mg/kg, 15 mg/kg, 20 mg/kg, 25 mg/kg, 30 mg/kg, or 40 mg/kg or more of a subject's body weight.

The dose can be administered according to a suitable schedule, for example, weekly, once every two weeks, once every three weeks, or once every four weeks. In some embodiments, an antibody to be administered once every three or four weeks may be administered at a higher dose than the antibody administered every one or two weeks. In some embodiments, a loading dose is administered that is higher than the maintenance dose administered thereafter. It may be necessary to use dosages of the ABP outside the ranges disclosed herein in some cases, as will be apparent to those of ordinary skill in the art. Furthermore, it is noted that the clinician or treating physician will know how and when to interrupt, adjust, or terminate therapy in conjunction with subject response.

Different therapeutically effective amounts may be applicable for different diseases and conditions, as will be readily known by those of ordinary skill in the art. Similarly, amounts sufficient to prevent, manage, treat or ameliorate such disorders, but insufficient to cause, or sufficient to reduce, adverse effects associated with the ABPs provided herein are also encompassed by the dosage amounts and dose frequency schedules provided herein. Further, when a subject is administered multiple dosages of a composition provided herein, not all of the dosages need be the same. For example, the dosage administered to the subject may be increased to improve the prophylactic or therapeutic effect of the composition or it may be decreased to reduce one or more side effects that a particular subject is experiencing.

In certain embodiments, treatment or prevention can be initiated with one or more loading doses of an ABP or composition provided herein followed by one or more maintenance doses.

In certain embodiments, a dose of an ABP or composition provided herein can be administered to achieve a steady-state concentration of the ABP in blood or serum of the subject. The steady-state concentration can be determined by measurement according to techniques available to those of skill or can be based on the physical characteristics of the subject such as height, weight and age.

In certain embodiments, administration of the same composition may be repeated and the administrations may be separated by at least 1 day, 2 days, 3 days, 5 days, 10 days, 15 days, 30 days, 45 days, 2 months, 75 days, 3 months, or 6 months.

As discussed in more detail elsewhere in this disclosure, an ABP provided herein may optionally be administered with one or more additional agents useful to prevent or treat a disease or disorder. The effective amount of such additional agents may depend on the amount of ABP present in the formulation, the type of disorder or treatment, and the other factors known in the art or described herein.

Therapeutic Applications

For therapeutic applications, the ABPs of the invention are administered to a mammal, generally a human, in a pharmaceutically acceptable dosage form such as those known in the art and those discussed above. For example, the ABPs of the invention may be administered to a human intravenously as a bolus or by continuous infusion over a period of time, by intramuscular, intraperitoneal, intra-cerebrospinal, subcutaneous, intra-articular, intrasynovial, intrathecal, or intratumoral routes. The ABPs also are suitably administered by peritumoral, intralesional, or perilesional routes, to exert local as well as systemic therapeutic effects. The intraperitoneal route may be particularly useful, for example, in the treatment of ovarian tumors.

The ABPs provided herein may be useful for the treatment of any disease or condition involving GITR. In some embodiments, the disease or condition is a disease or condition that can benefit from treatment with an anti-GITR ABP. In some embodiments, the disease or condition is a tumor. In some embodiments, the disease or condition is a cell proliferative disorder. In some embodiments, the disease or condition is a cancer.

In some embodiments, the ABPs provided herein are provided for use as a medicament. In some embodiments, the ABPs provided herein are provided for use in the manufacture or preparation of a medicament. In some embodiments, the medicament is for the treatment of a disease or condition that can benefit from an anti-GITR ABP. In some embodiments, the disease or condition is a tumor. In some embodiments, the disease or condition is a cell proliferative disorder. In some embodiments, the disease or condition is a cancer.

Any suitable cancer may be treated with the ABPs provided herein. Illustrative suitable cancers include, for example, acute lymphoblastic leukemia (ALL), acute myeloid leukemia (AML), adrenocortical carcinoma, anal cancer, appendix cancer, astrocytoma, basal cell carcinoma, brain tumor, bile duct cancer, bladder cancer, bone cancer, breast cancer, bronchial tumor, carcinoma of unknown primary origin, cardiac tumor, cervical cancer, chordoma, colon cancer, colorectal cancer, craniopharyngioma, ductal carcinoma, embryonal tumor, endometrial cancer, ependymoma, esophageal cancer, esthesioneuroblastoma, fibrous histiocytoma, Ewing sarcoma, eye cancer, germ cell tumor, gallbladder cancer, gastric cancer, gastrointestinal carcinoid tumor, gastrointestinal stromal tumor, gestational trophoblastic disease, glioma, head and neck cancer, hepatocellular cancer, histiocytosis, Hodgkin lymphoma, hypopharyngeal cancer, intraocular melanoma, islet cell tumor, Kaposi sarcoma, kidney cancer, Langerhans cell histiocytosis, laryngeal cancer, lip and oral cavity cancer, liver cancer, lobular carcinoma in situ, lung cancer, macroglobulinemia, malignant fibrous histiocytoma, melanoma, Merkel cell carcinoma, mesothelioma, metastatic squamous neck cancer with occult primary, midline tract carcinoma involving NUT gene, mouth cancer, multiple endocrine neoplasia syndrome, multiple myeloma, mycosis fungoides, myelodysplastic syndrome, myelodysplastic/myeloproliferative neoplasm, nasal cavity and par nasal sinus cancer, nasopharyngeal cancer, neuroblastoma, non-small cell lung cancer, oropharyngeal cancer, osteosarcoma, ovarian cancer, pancreatic cancer, papillomatosis, paraganglioma, parathyroid cancer, penile cancer, pharyngeal cancer, pheochromocytomas, pituitary tumor, pleuropulmonary blastoma, primary central nervous system lymphoma, prostate cancer, rectal cancer, renal cell cancer, renal pelvis and ureter cancer, retinoblastoma, rhabdoid tumor, salivary gland cancer, Sezary syndrome, skin cancer, small cell lung cancer, small intestine cancer, soft tissue sarcoma, spinal cord tumor, stomach cancer, T-cell lymphoma, teratoid tumor, testicular cancer, throat cancer, thymoma and thymic carcinoma, thyroid cancer, urethral cancer, uterine cancer, vaginal cancer, vulvar cancer, and Wilms tumor.

In some embodiments, provided herein is a method of treating a disease or condition in a subject in need thereof by administering an effective amount of an ABP provided herein to the subject. In some aspects, the disease or condition is a cancer.

In some embodiments, provided herein is a method of multimerizing GITR in a target cell of a subject in need thereof by administering an effective amount of an ABP provided herein to the subject.

In some embodiments, provided herein is a method of agonizing GITR in a target cell of a subject in need thereof by administering an effective amount of an ABP provided herein to the subject. In some aspects, agonism of GITR by an ABP provided herein results in increased secretion of IL-2Rα, IL-2, IL-8, and/or IFNγ by a target cell.

In some embodiments, provided herein is a method of modulating NF-κB activity in a target cell of a subject in need thereof by administering an effective amount of an ABP provided herein to the subject.

In some embodiments, provided herein is a method of modulating degradation of IκB in a target cell of a subject in need thereof by administering an effective amount of an ABP provided herein to the subject.

In some embodiments, provided herein is a method of activating the MAPK pathway in a target cell of a subject in need thereof by administering an effective amount of an ABP provided herein to the subject. In some aspects, the components of the MAPK pathway that are activated by an ABP provided herein include one or more of p38, JNK, and ERK.

In some embodiments, provided herein is a method of increasing the proliferation, survival, and/or function of an effector T cell in a subject in need thereof by administering an effective amount of an ABP provided herein to the subject. In some aspects the effector T cell is a CD4+ effector T cell. In some aspects, the effector T cell is a CD8+ effector T cell.

In some embodiments, provided herein is a method of abrogating suppression of an effector T cell by a regulatory T cell in a subject in need thereof by administering an effective amount of an ABP provided herein to the subject. In some aspects, the regulatory T cell is a CD4+CD25+ Foxp3+ regulatory T cell. In some aspects, the regulatory T cell is a CD8+CD25+ regulatory T cell.

In some embodiments, provided herein is a method of altering the frequency of occurrence or distribution or regulatory T cells in a subject in need thereof by administering an effective amount of an ABP provided herein to the subject. In some aspects, the frequency of regulatory T cells is decreased. In some aspects, the frequency of regulatory T cells is reduced in a particular tissue. In some aspects, the intratumoral accumulation of regulatory T cells is decreased, resulting in a more favorable ratio of effector T cells to regulatory T cells, and enhancing CD8+ T cell activity.

In some embodiments, provided herein is a method of increasing the activity of a natural killer (NK) cell in a subject in need thereof by administering an effective amount of an ABP provided herein to the subject.

In some embodiments, provided herein is a method of increasing the activity of a dendritic cell in a subject in need thereof by administering an effective amount of an ABP provided herein to the subject.

In some embodiments, provided herein is a method of increasing the activity of a B cell in a subject in need thereof by administering an effective amount of an ABP provided herein to the subject.

In some embodiments, provided herein is a method of enhancing an immune response in a subject in need thereof by administering an effective amount of an ABP provided herein to the subject.

In some embodiments, provided herein is a method delaying the onset of a tumor in a subject in need thereof by administering an effective amount of an ABP provided herein to the subject.

In some embodiments, provided herein is a method of delaying the onset of a cancer in a subject in need thereof by administering an effective amount of an ABP provided herein to the subject.

In some embodiments, provided herein is a method of reducing the size of a tumor in a subject in need thereof by administering an effective amount of an ABP provided herein to the subject.

In some embodiments, provided herein is a method of reducing the number of metastases in a subject in need thereof by administering an effective amount of an ABP provided herein to the subject.

Combination Therapies

In some embodiments, an ABP provided herein is administered with at least one additional therapeutic agent. Any suitable additional therapeutic agent may be administered with an ABP provided herein. In some aspects, the additional therapeutic agent is selected from radiation, a cytotoxic agent, a chemotherapeutic agent, a cytostatic agent, an anti-hormonal agent, an EGFR inhibitor, an immunostimulatory agent, an anti-angiogenic agent, and combinations thereof.

In some embodiments, the additional therapeutic agent comprises an immunostimulatory agent.

In some embodiments, the immunostimulatory agent is an agent that blocks signaling of an inhibitory receptor of an immune cell, or a ligand thereof. In some aspects, the inhibitory receptor or ligand is selected from CTLA-4, PD-1, PD-L1, NRP-1, LAG-3, Tim3, TIGIT, neuritin, BTLA, KIR, and combinations thereof. In some aspects, the agent is selected from pembrolizumab (anti-PD-1), nivolumab (anti-PD-1), atezolizumab (anti-PD-L1), ipilimumab (anti-CTLA-4), and combinations thereof.

In some embodiments, the immunostimulatory agent is an agonist of a co-stimulatory receptor of an immune cell. In some aspects, the co-stimulatory receptor is selected from OX40, ICOS, CD27, CD28, 4-1BB, or CD40. In some embodiments, the agonist is an antibody.

In some embodiments, the immunostimulatory agent is a cytokine. In some aspects, the cytokine is selected from IL-2, IL-5, IL-7, IL-12, IL-15, IL-21, and combinations thereof.

In some embodiments, the immunostimulatory agent is an oncolytic virus. In some aspects, the oncolytic virus is selected from a herpes simplex virus, a vesicular stomatitis virus, an adenovirus, a Newcastle disease virus, a vaccinia virus, and a maraba virus.

In some embodiments, the immunostimulatory agent is a T cell with a chimeric antigen receptor (CAR-T cell). In some embodiments, the immunostimulatory agent is a bi- or multi-specific T cell directed antibody. In some embodiments, the immunostimulatory agent is an anti-TGF-β antibody. In some embodiments, the immunostimulatory agent is a TGF-β trap.

In some embodiments, the additional therapeutic agent is a vaccine to a tumor antigen. Any suitable antigen may be targeted by the vaccine, provided that it is present in a tumor treated by the methods provided herein. In some aspects, the tumor antigen is a tumor antigen that is overexpressed in comparison its expression levels in normal tissue. In some aspects, the tumor antigen is selected from cancer testis antigen, differentiation antigen, NY-ESO-1, MAGE-A1, MART, and combinations thereof.

Further examples of additional therapeutic agents include a taxane (e.g., paclitaxel or docetaxel); a platinum agent (e.g., carboplatin, oxaliplatin, and/or cisplatin); a topoisomerase inhibitor (e.g., irinotecan, topotecan, etoposide, and/or mitoxantrone); folinic acid (e.g., leucovorin); or a nucleoside metabolic inhibitor (e.g., fluorouracil, capecitabine, and/or gemcitabine). In some embodiments, the additional therapeutic agent is folinic acid, 5-fluorouracil, and/or oxaliplatin. In some embodiments, the additional therapeutic agent is 5-fluorouracil and irinotecan. In some embodiments, the additional therapeutic agent is a taxane and a platinum agent. In some embodiments, the additional therapeutic agent is paclitaxel and carboplatin. In some embodiments, the additional therapeutic agent is pemetrexate. In some embodiments, the additional therapeutic agent is a targeted therapeutic such as an EGFR, RAF or MEK-targeted agent.

The additional therapeutic agent may be administered by any suitable means. In some embodiments, an ABP provided herein and the additional therapeutic agent are included in the same pharmaceutical composition. In some embodiments, an ABP provided herein and the additional therapeutic agent are included in different pharmaceutical compositions.

In embodiments where an ABP provided herein and the additional therapeutic agent are included in different pharmaceutical compositions, administration of the ABP can occur prior to, simultaneously, and/or following, administration of the additional therapeutic agent. In some aspects, administration of an ABP provided herein and the additional therapeutic agent occur within about one month of each other. In some aspects, administration of an ABP provided herein and the additional therapeutic agent occur within about one week of each other. In some aspects, administration of an ABP provided herein and the additional therapeutic agent occur within about one day of each other. In some aspects, administration of an ABP provided herein and the additional therapeutic agent occur within about twelve hours of each other. In some aspects, administration of an ABP provided herein and the additional therapeutic agent occur within about one hour of each other.

Diagnostic Methods

Also provided are methods for detecting the presence of GITR on cells from a subject. Such methods may be used, for example, to predict and evaluate responsiveness to treatment with an ABP provided herein.

In some embodiments, a blood sample is obtained from a subject and the fraction of cells expressing GITR is determined. In some aspects, the relative amount of GITR expressed by such cells is determined. The fraction of cells expressing GITR and the relative amount of GITR expressed by such cells can be determined by any suitable method. In some embodiments, flow cytometry is used to make such measurements. In some embodiments, fluorescence assisted cell sorting (FACS) is used to make such measurement. See Li et al., *J. Autoimmunity*, 2003, 21:83-92 for methods of evaluating expression of GITR in peripheral blood.

Kits

Also provided are kits comprising the ABPs provided herein. The kits may be used for the treatment, prevention, and/or diagnosis of a disease or disorder, as described herein.

In some embodiments, the kit comprises a container and a label or package insert on or associated with the container. Suitable containers include, for example, bottles, vials, syringes, and IV solution bags. The containers may be formed from a variety of materials, such as glass or plastic. The container holds a composition that is by itself, or when combined with another composition, effective for treating, preventing and/or diagnosing a disease or disorder. The container may have a sterile access port. For example, if the container is an intravenous solution bag or a vial, it may have a port that can be pierced by a needle. At least one active agent in the composition is an ABP provided herein. The label or package insert indicates that the composition is used for treating the selected condition.

In some embodiments, the kit comprises (a) a first container with a first composition contained therein, wherein the first composition comprises an ABP provided herein; and (b) a second container with a second composition contained therein, wherein the second composition comprises a further therapeutic agent. The kit in this embodiment of the invention may further comprise a package insert indicating that the compositions can be used to treat a particular condition.

Alternatively, or additionally, the kit may further comprise a second (or third) container comprising a pharmaceutically-acceptable excipient. In some aspects, the excipient is a buffer. The kit may further include other materials desirable from a commercial and user standpoint, including filters, needles, and syringes.

Other Illustrative Embodiments

The embodiments provided below are non-limiting and provided by way of illustration of certain embodiments and aspects of the invention, in addition to those described throughout this disclosure.

Embodiment 1

An ABP that binds specifically to a human GITR and/or a human GITR complex and is capable of at least one of the following: a) cross-competes with GITRL for binding to GITR; b) can be internalized into a human cell; c) inhibits suppression of an effector T cell; d) inhibits regulatory T cell inhibition of effector T cells; e) decreases the number of regulatory T cells in tissues or in circulation; 0 activates an effector T cell; g) associates GITR into a GITR complex; h) modulates an activity of a human GITR and/or a GITR complex.

Embodiment 2

The ABP of embodiment 1, wherein the ABP has one or more of the following characteristics: a) is a monoclonal antibody; b) is a human antibody, a humanized antibody, or a chimeric antibody; c) is a multispecific or multivalent antibody, e.g., a tetravalent antibody; d) comprises a at least one Fab at the N-terminus or the C-terminus; e) is of the IgG1, IgG2, IgG3, or the IgG4 type; f) is an antigen-binding antibody fragment; g) is a Fab fragment, a Fab' fragment, a F(ab')2 fragment, or an Fv fragment; h) is a bispecific antibody, a diabody, a single chain antibody, a single domain antibody, a $V_H$ domain antibody, or a nanobody.

Embodiment 3

The ABP of embodiment 1, wherein the ABP has one or more of the following characteristics: a) binds to a human GITR polypeptide of SEQ ID NOs: 1-2 or a variant thereof, or as otherwise provided herein with a $K_D$ of less than about 20 nM; or b) binds to a cyno GITR polypeptide of SEQ ID NO: 3 or a variant thereof, or as otherwise provided herein, with a $K_D$ of less than about 200 nM.

Embodiment 4

The ABP of embodiment 1, comprising a first antigen-binding domain that specifically binds to a first antibody recognition domain on human GITR and a second antigen-binding domain that specifically binds to a second antibody recognition domain on human GITR, wherein the first antibody recognition domain and the second antibody recognition domain are not identical.

Embodiment 5

The ABP of embodiment 4, comprising a bispecific binding protein in a format selected from the group consisting of a DVD-Ig™ molecule, a BiTe® molecule, a DART™ molecule, a DuoBody® molecule, a scFv/diabody-IgG molecule, a cross-over multispecific molecule, a 2-in-1 bispecific molecule, a knob-in-hole multispecific molecule, a Fab+IgG molecule, a CovX-Body molecule, an affibody molecule, a scFv/diabody-$C_{H2}$/$C_{H3}$ bispecific molecule, a IgG-non-Ig protein scaffold-based multispecific molecule, a Fynomer® molecule, a Fcab™ molecule, a TandAb®, a Zybody™, and a scFV/diabody linked to normal human protein like human serum albumin-bispecific molecule.

Embodiment 6

The ABP of embodiment 4, wherein the first antigen-binding domain has a $K_D$ of less than about 20 nM and is capable of agonizing human GITR, and wherein the second antigen-binding domain has a $K_D$ of less than about 100 nM.

Embodiment 7

An ABP that competes or is capable of competing for binding to human GITR with a reference ABP, wherein the reference ABP is the ABP of embodiment 1.

Embodiment 8

The ABP of embodiment 7, wherein the ABP and the reference antibody cross-compete or are capable of cross-competing for binding to a human GITR.

Embodiment 9

The ABP of embodiment 1, comprising a heavy chain constant region comprising a human heavy chain constant region or fragment or a variant thereof, wherein the constant region variant comprises up to 20 modified amino acid substitutions, wherein from 0 to up to 20 modified amino acid substitutions are conservative amino acid substitutions.

Embodiment 10

The ABP of embodiment 1, that competes or is capable of competing for binding to human GITRL with a GITR protein.

Embodiment 11

The ABP of embodiment 1, that is capable of activating GITR signaling in a ligand-independent manner.

Embodiment 12

The ABP of embodiment 1, that is capable of enhancing ligand-dependent binding of GITR and GITRL.

Embodiment 13

A pharmaceutical composition comprising an ABP of any one of embodiments 1-12 in a pharmaceutically acceptable carrier.

Embodiment 14

A bispecific antibody comprising a first antigen-binding domain that specifically binds to a first antibody recognition domain on human GITR and a second antigen-binding domain that specifically binds to a second antibody recognition domain on human GITR, wherein the first antibody recognition domain and the second antibody recognition domain are not identical.

Embodiment 15

The bispecific antibody of embodiment 14, wherein the first antibody recognition domain and the second antibody recognition domain are present in the extracellular domain of human GITR.

Embodiment 16

The bispecific antibody of embodiment 14, wherein the first antibody recognition domain and the second antibody recognition domain are capable of associating at least two human GITR proteins into a functional complex.

Embodiment 17

A complexing ABP comprising a first antigen-binding domain that specifically binds to a first antibody recognition domain on a human GITR protein or a human GITR complex comprising at least two GITR proteins, and is capable of at least one of the following: a) cross-competes with GITRL for binding to GITR; b) can be internalized into a human cell; c) inhibits suppression of an effector T cell; d) inhibits regulatory T cell inhibition of effector T cells; e) decreases the number of regulatory T cells in tissues or in circulation; f) activates an effector T cell; g) associates GITR into a GITR complex; h) modulates an activity of a human GITR and/or a GITR complex.

Embodiment 18

An isolated nucleic acid encoding an ABP according to any one of embodiments 1 to 12 or a bispecific antibody according to any one of embodiments 14-16 or the complexing ABP of embodiment 17.

Embodiment 19

An expression vector comprising the nucleic acid according to embodiment 18.

Embodiment 20

A prokaryotic or eukaryotic host cell comprising a vector of embodiment 19.

Embodiment 21

A method for the production of a recombinant protein comprising the steps of expressing a nucleic acid according to embodiment 18 in a prokaryotic or eukaryotic host cell and recovering said protein from said cell or the cell culture supernatant.

Embodiment 22

A method for treatment of a subject suffering from cancer or from an inflammatory disease, comprising the step of administering to the subject a pharmaceutical composition comprising an ABP according to any one of embodiments 1 to 12 or a bispecific antibody according to any one of embodiments 14-16 or the complexing ABP of embodiment 17.

Embodiment 23

A method for inducing or enhancing an immune response in a subject, comprising the step of administering to the subject a pharmaceutical composition comprising an ABP according to any one of embodiments 1 to 12 or a bispecific antibody according to any one of embodiments 14-16 or the complexing ABP of embodiment 17, wherein the immune response is generated against a tumor antigen.

Embodiment 24

The method of embodiment 23, wherein the ABP, bispecific antibody or the complexing ABP is administered in an amount sufficient to achieve one or more of the following in the subject: a) reduce regulatory T cells suppression of activity of effector T cells; b) decrease levels of regulatory T cells; c) activation of effector T cells; d) induce or enhance effector T cell proliferation; e) inhibit tumor growth; and f) induce tumor regression.

Embodiment 25

The method of embodiment 22, wherein the cancer is a solid cancer.

Embodiment 26

The method of embodiment 22, wherein the cancer is a hematological cancer.

Embodiment 27

The method of any one of embodiments 22-26, wherein the method further comprises one or more of the following a) administering chemotherapy; b) administering radiation therapy; or c) administering one or more additional therapeutic agents.

Embodiment 28

The method of embodiment 27, wherein the additional therapeutic agent comprises an immunostimulatory agent.

Embodiment 29

The method of embodiment 27, wherein the immunostimulatory agent comprises an antagonist to an inhibitory receptor of an immune cell.

Embodiment 30

The method of embodiment 29, wherein the inhibitory receptor comprises
CTLA-4, PD-1, PD-L1, LAG-3, Tim3, TIGIT, neuritin, BTLA or KIR, or a functional fragment thereof.

Embodiment 31

The method of embodiment 27, wherein the immunostimulatory agent comprises an agonist of co-stimulatory receptor of an immune cell, or a functional fragment thereof.

Embodiment 32

The method of embodiment 31, wherein the co-stimulatory receptor comprises OX40, ICOS, CD27, CD28, 4-1BB, or CD40.

Embodiment 33

The method of embodiment 27, wherein the immunostimulatory agent comprises a cytokine.

Embodiment 34

The method of embodiment 27, wherein the cytokine comprises IL-2, IL-5, IL-7, IL-12, IL-15 or IL-21.

Embodiment 35

The method of embodiment 27, wherein the immunostimulatory agent comprises an oncolytic virus.

Embodiment 36

The method of embodiment 35, wherein the oncolytic virus comprises a Herpes simplex virus, a Vesicular stomatitis virus, an adenovirus, a Newcastle disease virus, a vaccinia virus, or a maraba virus.

Embodiment 37

The method of embodiment 27, wherein the immunostimulatory agent comprises a chimeric antigen engineered T cell.

Embodiment 38

The method of embodiment 27, wherein the immunostimulatory agent comprises a bi- or multi-specific T cell directed antibody.

Embodiment 39

The method of embodiment 27, wherein the additional therapeutic agent comprises an anti-TGF-β antibody or a TGF-β receptor trap.

Embodiment 40

The method of any one of embodiments 22-39, wherein administration of the pharmaceutical composition results in induction or enhancement of proliferation of a T-effector cell, or modulation of I-kappaB and/or NF-κB in the T cell, or modulation of GITR activity in the T cell, or T cell receptor induced signaling in a T-effector cell, or a combination thereof.

Embodiment 41

A method of screening for test compounds comprising an ABP according to any one of embodiments 1 to 12 that are capable of inhibiting the interaction of GITRL with GITR complex comprising the steps of: contacting a sample containing GITRL and GITR complex with the compound; and determining whether the interaction of GITRL with GITR complex in the sample is decreased relative to the interaction of GITRL with GITR complex in a sample not contacted with the compound, whereby a decrease in the interaction of GITRL with GITR in the sample contacted with the compound identifies the compound as one that inhibits the interaction of GITRL with GITR complex.

EXAMPLES

The following are examples of methods and compositions of the invention. It is understood that various other embodiments may be practiced, given the general description provided herein.

Example 1: Selection of GITR Antigen-Binding Proteins

Materials and Methods

Antigens were biotinylated using the EZ-Link® Sulfo-NHS-Biotinylation Kit from Pierce. Goat F(ab')$_2$ anti-human kappa-FITC (LC-FITC), ExtrAvidin®-PE (EA-PE) and Streptavidin-AF633 (SA-633) were obtained from Southern Biotech, Sigma, and Molecular Probes, respectively. Streptavidin MicroBeads® and MACS LC separation columns were purchased from Miltenyi Biotec. Goat anti-human IgG-PE (Human-PE) was obtained from Southern Biotech.

Naïve Discovery

Eight naïve human synthetic yeast libraries each of ~$10^9$ diversity were propagated as previously described (see, e.g., Y. Xu et al, Addressing polyspecificity of antibodies selected from an in vitro yeast presentation system: a FACS-based, high-throughput selection and analytical tool. *PEDS* 26.10, 663-70 (2013); WO2009036379; WO2010105256; and WO2012009568.) For the first two rounds of selection, a magnetic bead sorting technique utilizing the Miltenyi MACS system was performed, as previously described (see, e.g., Siegel et al, High efficiency recovery and epitope-specific sorting of an scFv yeast display library." *J. Immunol Methods* 286(1-2), 141-153 (2004).) Briefly, yeast cells (—$10^{10}$ cells/library) were incubated with 5 ml of 10 nM biotinylated Fc fusion antigen for 30 min at 30° C. in wash buffer (phosphate-buffered saline (PBS)/0.1% bovine serum albumin (BSA)). After washing once with 40 ml ice-cold wash buffer, the cell pellet was resuspended in 20 mL wash buffer, and Streptavidin MicroBeads® (500 µl) were added to the yeast and incubated for 15 min at 4° C. Next, the yeast were pelleted, resuspended in 20 mL wash buffer, and loaded onto a Miltenyi LS column. After the 20 mL were loaded, the column was washed 3 times with 3 ml wash buffer. The column was then removed from the magnetic field, and the yeast were eluted with 5 mL of growth media and then grown overnight. The following rounds of selection were performed using flow cytometry. Approximately 2×$10^7$ yeast were pelleted, washed three times with wash buffer, and incubated at 30° C. with either decreasing concentrations of biotinylated Fc fusion antigen (10 to 1 nM) under equilibrium conditions, 10 nM biotinylated Fc fusion antigens of different species in order to obtain species cross-reactivity, or with a poly-specificity depletion reagent (PSR) to remove non-specific antibodies from the selection. For the PSR depletion, the libraries were incubated with a 1:10 dilution of biotinylated PSR reagent as previously described (see, Y. Xu et al, Addressing polyspecificity of antibodies selected from an in vitro yeast presentation system: a FACS-based, high-throughput selection and analytical tool. *PEDS* 26.10, 663-70 (2013).) Yeast were then washed twice with wash buffer and stained with LC-FITC (diluted 1:100) and either SA-633 (diluted 1:500) or EAPE (diluted 1:50) secondary reagents for 15 min at 4° C. After washing twice with wash buffer, the cell pellets were resuspended in 0.3 mL wash buffer and transferred to strainer-capped sort tubes. Sorting was performed using a FACS ARIA sorter (BD Biosciences) and sort gates were determined to select for antibodies with desired characteristics. Selection rounds were repeated until a population with all of the desired characteristics was obtained. After the final round of sorting, yeast were plated and individual colonies were picked for characterization.

Antibody Optimization

Optimization of antibodies was performed via a light chain diversification protocol, and then by introducing diversities into the heavy chain and light chain variable regions as described below. A combination of some of these approaches was used for each antibody.

Light chain batch diversification protocol: Heavy chain plasmids from a naïve selection output were extracted from the yeast via smash and grab, propagated in and subsequently purified from E. coli, and transformed into a light chain library with a diversity of $5 \times 10^6$. Selections were performed with one round of MACS and four rounds of FACS employing the same conditions as the naïve discovery.

Light chain diversification: The heavy chain variable region of a single antibody was amplified via PCR and transformed, along with the heavy chain expression vector, into a light chain library with a diversity of $5 \times 10^6$. Selections were performed with one round of MACS and three rounds of FACS employing the same conditions as the naïve discovery. For each FACS round the libraries were looked at for PSR binding, species cross-reactivity, and affinity pressure, and sorting was performed in order to obtain a population with the desired characteristics.

CDRH1 and CDRH2 selection: The CDRH3 of a single antibody was recombined into a premade library with CDRH1 and CDRH2 variants of a diversity of $1 \times 10^8$ and selections were performed with one round of MACS and four rounds of FACS as described in the naïve discovery. For each FACS round, the libraries were looked at for PSR binding, species cross-reactivity, and affinity pressure, and sorting was performed in order to obtain a population with the desired characteristics. For these selections affinity pressures were applied by preincubating the biotinylated antigen with parental IgG for 30 minutes and then applying that precomplexed mixture to the yeast library for a length of time which would allow the selection to reach an equilibrium. The higher affinity antibodies were then able to be sorted.

CDRH3NH Mutant selection: Oligonucleotides (oligos) were ordered from IDT which comprised the CDRH3 as well as a flanking region on either side of the CDRH3. Amino acid positions in the CDRH3-encoding portion of the oligo were variegated by NNK diversity. The CDRH3 oligos were double-stranded using primers which annealed to the flanking region of the CDRH3, The remaining part of the heavy chain variable region was mutagenized via error prone PCR in order to introduce additional diversity in non-CDR3 regions of the heavy chain. The library was then created by transforming the double stranded CDRH3 oligo, the mutagenized remainder of the heavy chain variable region, and the heavy chain expression vector into yeast already containing the light chain plasmid of the parent. Selections were performed similar to previous cycles using FACS sorting for four rounds. For each FACS round, the libraries were looked at for PSR binding, species cross-reactivity, and affinity pressure, and sorting was performed in order to obtain a population with the desired characteristics. Affinity pressures for these selections were performed as described above in the CDRH1 and CDRH2 selection.

CDRL1, CDRL2, and CDRL3 selection: Oligos were ordered from IDT which comprised the CDRL3 as well as a flanking region on either side of the CDRL3. Amino acid positions in the CDRL3-encoding portion of the oligo were variegated by NNK diversity. The CDRL3 oligos were double-stranded using primers which annealed to the flanking region of the CDRL3. These double-stranded CDRL3 oligos were then recombined into a premade library with CDRL1 and CDRL2 variants of a diversity of $3 \times 10^5$ and selections were performed with one round of MACS and four rounds of FACS as described in the naïve discovery. For each FACS round the libraries were looked at for PSR binding, species cross-reactivity, and affinity pressure, and sorting was performed in order to obtain a population with the desired characteristics. Affinity pressures for these selections were performed as described above in the CDRH1 and CDRH2 selection.

Antibody Production and Purification

Yeast clones were grown to saturation and then induced for 48 h at 30° C. with shaking. After induction, yeast cells were pelleted and the supernatants were harvested for purification. IgGs were purified using a Protein A column and eluted with acetic acid, pH 2.0. Fab fragments were generated by papain digestion and purified over KappaSelect® (GE Healthcare LifeSciences).

ForteBio $K_D$ Measurements

ForteBio® affinity measurements were performed on an Octet® RED384 generally as previously described (see, e.g., Estep et al, High throughput solution-based measurement of antibody-antigen affinity and epitope binning. Mabs 5(2), 270-278 (2013)). Briefly, ForteBio affinity measurements were performed by loading IgGs on-line onto AHQ sensors. Sensors were equilibrated off-line in assay buffer for 30 min and then monitored on-line for 60 seconds for baseline establishment. Sensors with loaded IgGs were exposed to 100 nM antigen for 3 minutes, and afterwards were transferred to assay buffer for 3 min for off-rate measurement. For monovalent affinity assessment Fabs were used instead of IgGs. For this assessment, the unbiotinylated Fc fusion antigen was loaded on-line onto the AHQ sensors. Sensors were equilibrated off-line in assay buffer for 30 min and then monitored on-line for 60 seconds for baseline establishment. Sensors with loaded antigen were exposed to 200 nM Fab for 3 minutes, and afterwards they were transferred to assay buffer for 3 min for off-rate measurement. All kinetics were analyzed using the 1:1 binding model.

ForteBio Epitope Binning/Ligand Blocking

Epitope binning/ligand blocking was performed using a standard sandwich format cross-blocking assay. Control anti-target IgG was loaded onto AHQ sensors and unoccupied Fc-binding sites on the sensor were blocked with an irrelevant human IgG1 antibody. The sensors were then exposed to 100 nM target antigen followed by a second anti-target antibody or ligand. Additional binding by the second antibody or ligand after antigen association indicates an unoccupied epitope (non-competitor), while no binding indicates epitope blocking (competitor or ligand blocking).

Cell Binding Analysis

Approximately 100,000 cells overexpressing the antigen were washed with wash buffer and incubated with 100 µl 100 nM IgG for 5 minutes at room temperature. Cells were then washed twice with wash buffer and incubated with 100 ul of 1:100 Human-PE for 15 minutes on ice. Cells were then washed twice with wash buffer and analyzed on a FACS Canto II analyzer (BD Biosciences.)

Size Exclusion Chromatography

A TSKgel® SuperSW mAb HTP column (22855) was used for fast SEC analysis of mammalian produced mAbs at 0.4 mL/min with a cycle time of 6 min/run. 200 mM Sodium Phosphate and 250 mM Sodium Chloride was used as the mobile phase.

Dynamic Scanning Fluorimetry

10 μL of 20× Sypro Orange is added to 20 uL of 0.2-1 mg/mL mAb or Fab solution. An RT-PCR instrument (Bio-Rad CFX96 RT PCR) is used to ramp the sample plate temperature from 40 to 95 C at 0.5 C increment, with 2 min equilibrate at each temperature. The negative of first derivative for the raw data is used to extract Tm.

Example 2: Characteristics of TM Format Antibodies

Affinity of IgG1 and TM Format ABPs for GITR of Several Species

The GITR ABPs were evaluated for their ability to bind recombinant hGITR (SEQ ID NO: 1), hGITR-T43R (SEQ ID NO: 2), cGITR (SEQ ID NO: 3), and mGITR (SEQ ID NO: 4) using a FORTEBIO® OCTET instrument. The assay was performed at 30° C., using 1× Kinetics Buffer (ForteBio, Inc.) as an assay buffer. Anti-human IgG Fc Capture (AHC) biosensors (ForteBio, Inc.) were used to capture GITR ABPs onto the sensors. The sensors were equilibrated in assay buffer for 600 seconds before the assay. Baseline was established by dipping the sensors into 1× assay buffer for 60 seconds. ABPs were loaded onto the sensors by dipping the sensors into ABP solution for 300 seconds. Baseline was established by dipping the sensors into 1× assay buffer for 120 seconds. The sensors were quenched by dipping into 200 μg/ml human IgG for 300 seconds to prevent non-specific binding of GITR-Fc antigens to the sensor. Baseline was established by dipping the sensors into 1× assay buffer for 60 seconds. Next, association was monitored for 300 seconds in 25 nM of recombinant antigens, and dissociation was followed for 1200 seconds in buffer alone. $K_D$ was determined using the kinetic function of the FORTEBIO® Analysis Software using a 1:1 binding model. Results are shown in Table 5.

TABLE 5

| ABP $K_D$ by OCTET using single concentration kinetics | | | | | |
|---|---|---|---|---|---|
| ABP | Format | $K_D$ by Octet, single-concentration of human GITR-Fc, (nM) | $K_D$ by Octet, single-concentration of human GITR T43R-Fc (nM) | $K_D$ by Octet, single-concentration of cyno GITR-Fc (nM) | $K_D$ by Octet, single-concentration of mouse GITR-Fc (nM) |
| 1 | N-terminal Fab TM | 0.77 | 0.94 | 0.88 | No binding |
| 2 | N-terminal Fab TM | 0.55 | 0.73 | 0.79 | No binding |
| 3 | N-terminal Fab TM | 0.58 | 0.71 | 1.1 | No binding |
| 4 | N-terminal Fab TM | 0.5 | 0.72 | 1.19 | No binding |
| 5 | N-terminal Fab TM | 0.57 | 0.7 | 1.21 | No binding |
| 6 | N-terminal Fab TM | 0.63 | 0.71 | 1.09 | No binding |
| 7 | N-terminal Fab TM | 0.76 | 1.1 | 1.9 | No binding |
| 8 | N-terminal Fab TM | 0.73 | 1.02 | 0.94 | No binding |

Other GITR ABPs were evaluated for their ability to bind recombinant hGITR and cGITR (SEQ ID NO: 3) using a FORTEBIO® Octet RED384 instrument generally as previously described (see, e.g., Estep et al, High throughput solution-based measurement of antibody-antigen affinity and epitope binning Mabs 5(2), 270-278 (2013)). AHQ biosensors (ForteBio, Inc.) were used to capture GITR ABPs onto the sensors. The sensors were quenched by dipping into an unrelated human IgG1 antibody to prevent non-specific binding of GITR-Fc antigens to the sensor. The sensors were equilibrated in assay buffer for 30 minutes. Baseline was established by dipping the sensors into assay buffer for 60 seconds. Association was monitored for 180 seconds in 100 nM of recombinant antigens, and dissociation was followed for 180 seconds in buffer alone. $K_D$ was determined using the kinetic function of the FORTEBIO® Analysis Software using a 1:1 binding model. Results are shown in Table 6.

TABLE 6

ABP $K_D$ by OCTET using single concentration kinetics

| ABP | Format | $K_D$ by Octet, single-concentration of human GITR-Fc, (nM) | $K_D$ by Octet, single-concentration of cyno GITR-Fc (nM) |
|---|---|---|---|
| 35 (non-TM ABP corresponding to ABP1) | IgG1 N297A | 1.5 | 5.7 |
| 36 (non-TM ABP corresponding to ABP2) | IgG1 N297A | 1.4 | 7.5 |
| 37 (non-TM ABP corresponding to ABP3) | IgG1 N297A | 0.7 | 8.1 |
| 38 (non-TM ABP corresponding to ABP4/5) | IgG1 N297A | 0.6 | 11.1 |
| 39 (non-TM ABP corresponding to ABP6) | IgG1 N297A | 0.7 | 8.2 |
| 40 (non-TM ABP corresponding to ABP7) | IgG1 N297A | 2.2 | 4.9 |
| 41 (non-TM ABP corresponding to ABP8) | IgG1 N297A | 2.3 | 6.9 |
| 19 | N terminal Fab TM | 5.2 | 12.6 |
| 20 | N terminal Fab TM | 4.4 | 5.2 |
| 21 | N terminal Fab TM | 4.2 | 5.5 |
| 22 | N terminal Fab TM | 4.0 | 4.6 |
| 23 | N terminal Fab TM | 3.7 | No Binding |
| 24 | N terminal Fab TM | 6.6 | No Binding |
| 25 | C terminal Fab TM, linker = 15 mer | 4.5 | 11.0 |
| 26 | C terminal Fab TM, linker = 15 mer | 5.1 | 5.1 |
| 27 | C terminal Fab TM, linker = 15 mer | 4.2 | 7.3 |
| 28 | C terminal Fab TM, linker = 15 mer | 3.2 | 4.3 |
| 29 | C terminal Fab TM, linker = 15 mer | 5.7 | No Binding |
| 30 | C terminal Fab TM, linker = 15 mer | 5.6 | No Binding |
| 31 | C terminal Fab TM, linker = 5 mer | 7.6 | No Binding |
| 32 | C terminal Fab TM, linker = 5 mer | 6.4 | No Binding |
| 42 (ABPs 1-10, 23, 24, 29-32, 35-41, 43, 48, 49) | IgG1 N297A* | 11.5 | No Binding |
| 44 (ABPs 11, 12, 19, 25) | IgG1 N297A# | 46.5 | Poor Fit |
| 45 (ABPs 13, 20, 26, 45, 52) | IgG1 N297A# | 112.2 | Poor Fit |
| 46 (ABPs 14-16, 21, 27, 53-55) | IgG1 N297A# | 59.8 | 110.9 |
| 47 (ABPs 17, 18, 22, 28, 56, 57) | IgG1 N297A# | 44.3 | 88.1 |
| 48 (ABPs 10, 29, 31) | IgG1 N297A# | 14.8 | No Binding |
| 49 (ABPs 24, 30, 32) | IgG1 N297A# | 63.5 | No Binding |
| 11 | IgG1 format | 3.1 | 8.5 |
| 12 | IgG1 format | 2.8 | 7.9 |
| 13 | IgG1 format | 5.5 | 6.4 |
| 14 | IgG1 format | 2.8 | 5.9 |
| 15 | IgG1 format | 3.3 | 5.2 |
| 16 | IgG1 format | 2.9 | 5.4 |
| 17 | IgG1 format | 4.2 | 4.6 |
| 18 | IgG1 format | 4.0 | 8.4 |

Figure 1A:
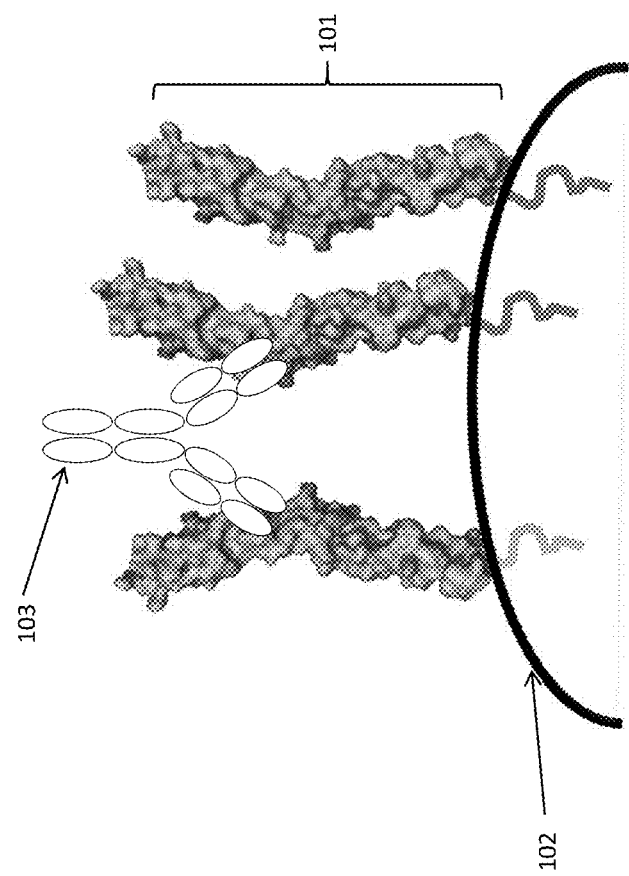
FIG. 1A provides a schematic illustration of a mechanism of action of certain illustrative GITR ABPs provided herein.
Figure 1B:
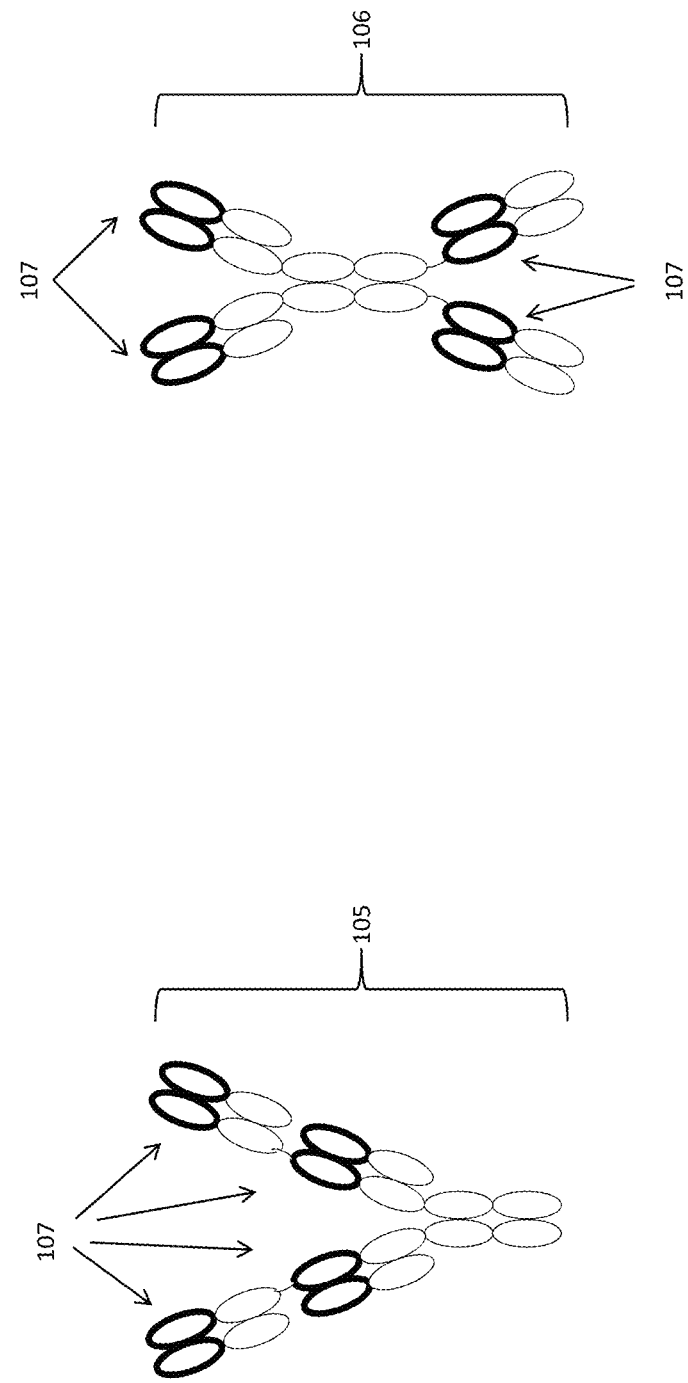
FIG. 1B provides a schematic illustration of a mechanism of action of certain illustrative GITR ABPs provided herein.
Figure 1C:
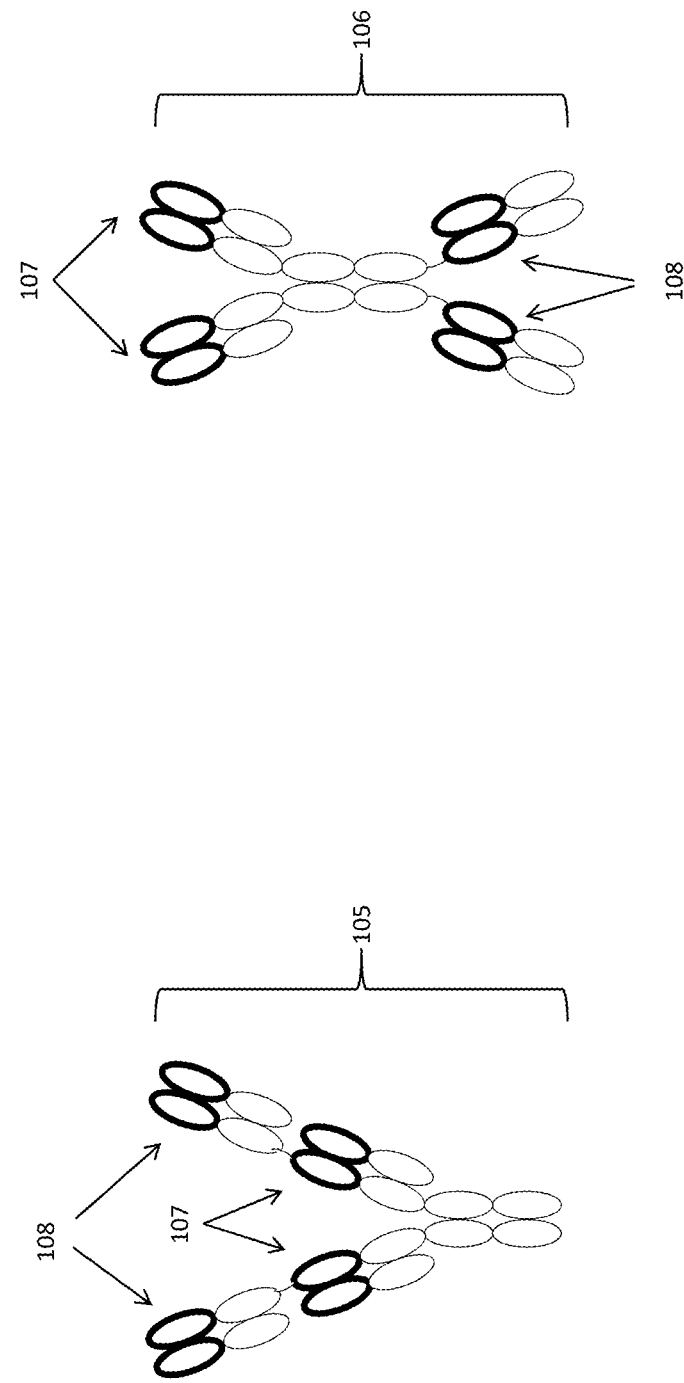
FIG. 1C provides a schematic illustration of a mechanism of action of certain illustrative GITR ABPs provided herein.
Figure 1D:
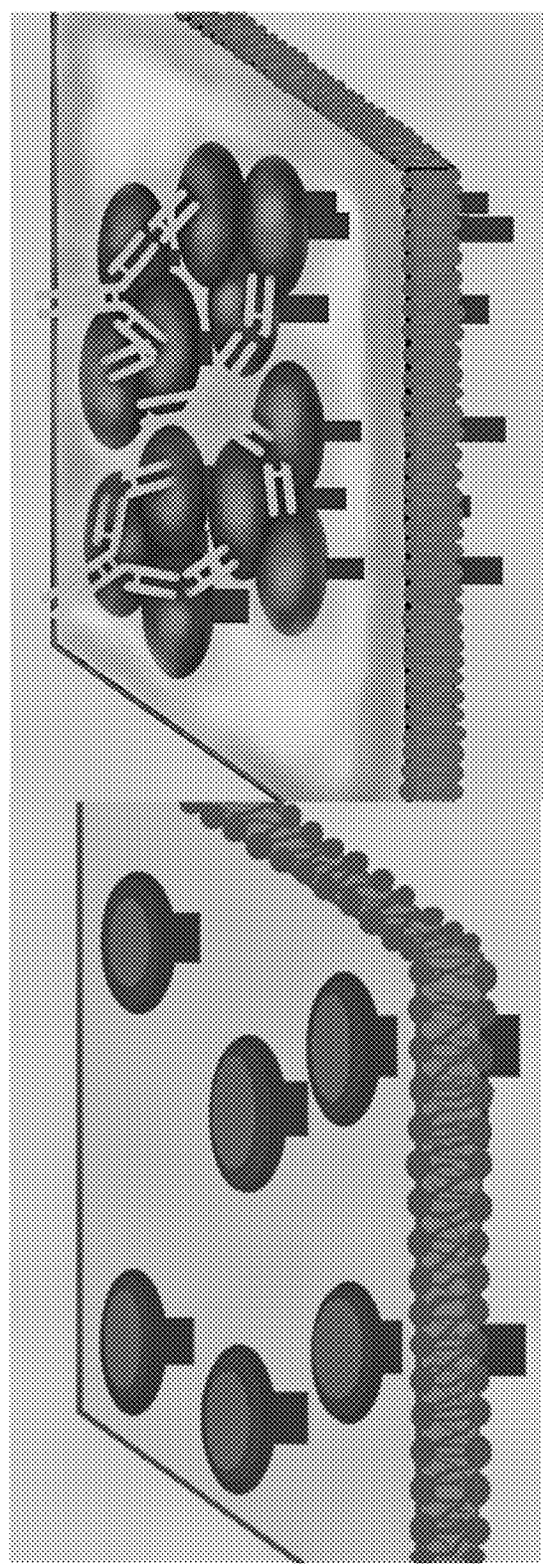
FIG. 1D provides a schematic illustration of a mechanism of action of certain illustrative GITR ABPs provided herein.
Figure 2:
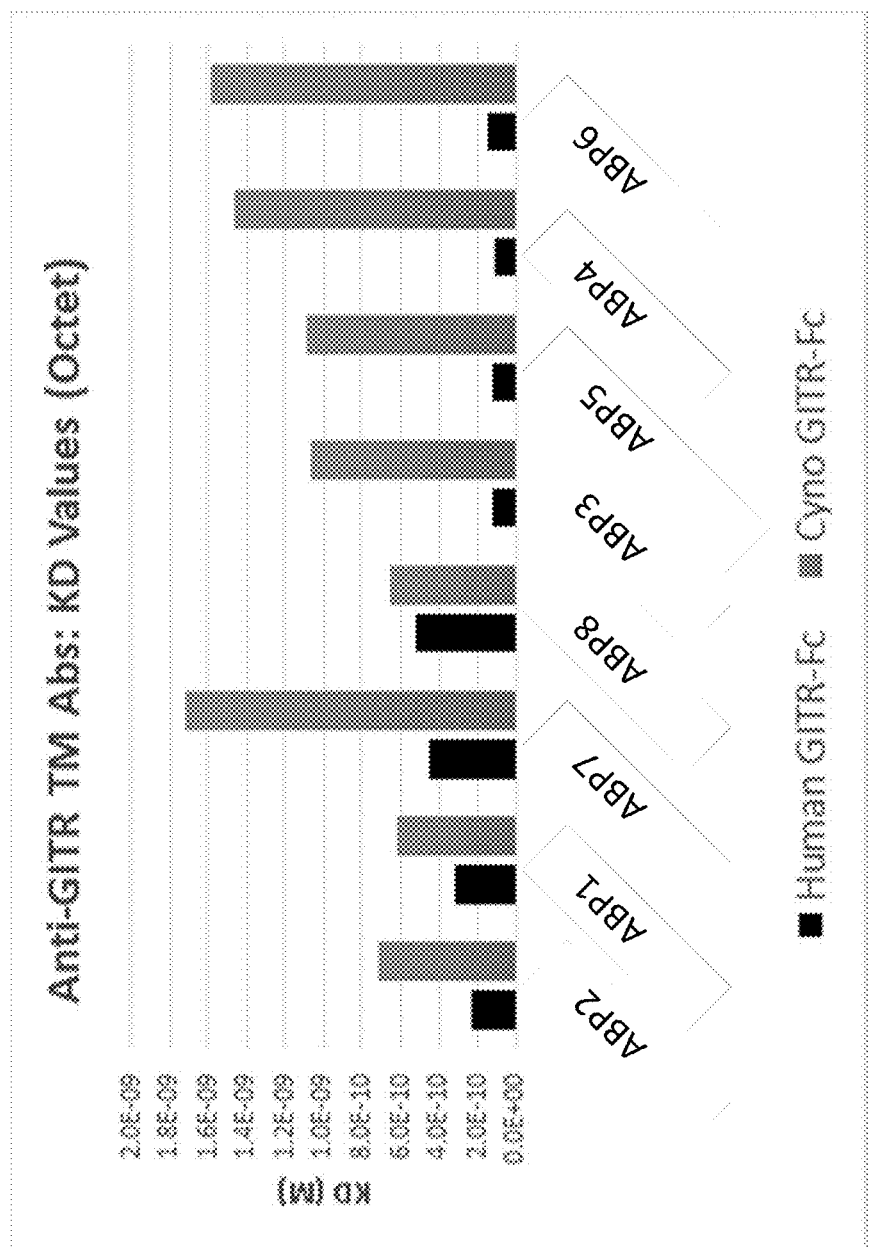
FIG. 2 is a graph showing exemplary results of determination of $K_D$ by OCTET for N-terminal Fab format ABPs 1-8.

*non-optimized, non-TM IgG1 ABPs corresponding to ABPs in parentheses
H1H2-optimized, non-TM IgG1 ABPs corresponding to ABPs in parentheses Additional $K_D$ measurements were performed on 8 N-terminal Fab TM format antibodies using multi-concentration kinetics. The GITR ABPs were evaluated for their ability to bind recombinant hGITR (SEQ ID NO: 1), hGITR-T43R (SEQ ID NO: 2), and cGITR (SEQ ID NO: 3) using a FORTEBIO® OCTET instrument. The assay was performed at 30° C., using 1× Kinetics Buffer (ForteBio, Inc.) as an assay buffer. Anti-human IgG Fc Capture (AHC) biosensors (ForteBio, Inc.) were used to capture GITR ABPs onto the sensors. The sensors were saturated in assay buffer for 600 seconds before the assay. Baseline was established by dipping the sensors into 1× assay buffer for 60 seconds. ABPs were loaded onto the sensors by dipping the sensors into ABP solution for 300 seconds. Baseline was established by dipping the sensors into 1× assay buffer for 120 seconds. Next, association was monitored for 300 seconds in various concentrations of recombinant antigens (50 nM to 0.78 nM, 2-fold dilutions in assay buffer), and dissociation was followed for 600 or 1200 seconds in buffer alone. $K_D$ was determined using the kinetic function of the FORTEBIO® Analysis Software using a 1:1 binding model. Results of determination of $K_D$ by OCTET are shown in FIG. 2 and in Table 7. As can be seen in the Figure, the $K_D$s for human GITR are each less than 1 nM, and the $K_D$s for cynomolgus GITR are within 15-fold of that of human. In addition, the TM format antibodies bind the T43R SNP variant of human GITR.

TABLE 7

N-terminal Fab TM format ABP Binding Characteristics

| ABP | Human GITR-Fc $K_D$ (M), n = 3 | Human GITR-Fc T43R $K_D$ (M), n = 1 | Cyno GITR-Fc $K_D$ (M), n = 3 |
|---|---|---|---|
| 1 | 3.2E−10 | 5.3E−10 | 6.2E−10 |
| 2 | 2.3E−10 | 1.0E−10 | 7.1E−10 |
| 3 | 1.2E−10 | 2.7E−12 | 1.1E−09 |
| 4 | 1.1E−10 | 4.5E−12 | 1.5E−09 |
| 5 | 1.2E−10 | 7.3E−11 | 1.1E−09 |
| 6 | 1.5E−10 | 3.5E−11 | 1.6E−09 |
| 7 | 4.5E−10 | 7.0E−10 | 1.7E−09 |
| 8 | 5.2E−10 | 6.6E−10 | 6.6E−10 |

GITR Binding Assays

Peripheral Blood Mononuclear Cells (PBMCs) were cultured in growth medium in the presence of phytohemagglutinin (PHA) for 5 days at 37° C. to upregulate GITR expression. T cells were collected and washed and then incubated at 4° C. with one of eight TM format GITR ABPs or a human isotype control antibody. After washing, cells were incubated at 4° C. with fluorochrome conjugated anti-human CD4 antibody and anti-human CD8 antibody as well as fluorochrome-conjugated anti-human IgG to detect bound anti-human GITR ABPs. The percentage of GITR+ CD4 and CD8 cells as well as the mean fluorescence intensity (MFI) is determined by flow cytometry.

Figure 3A:
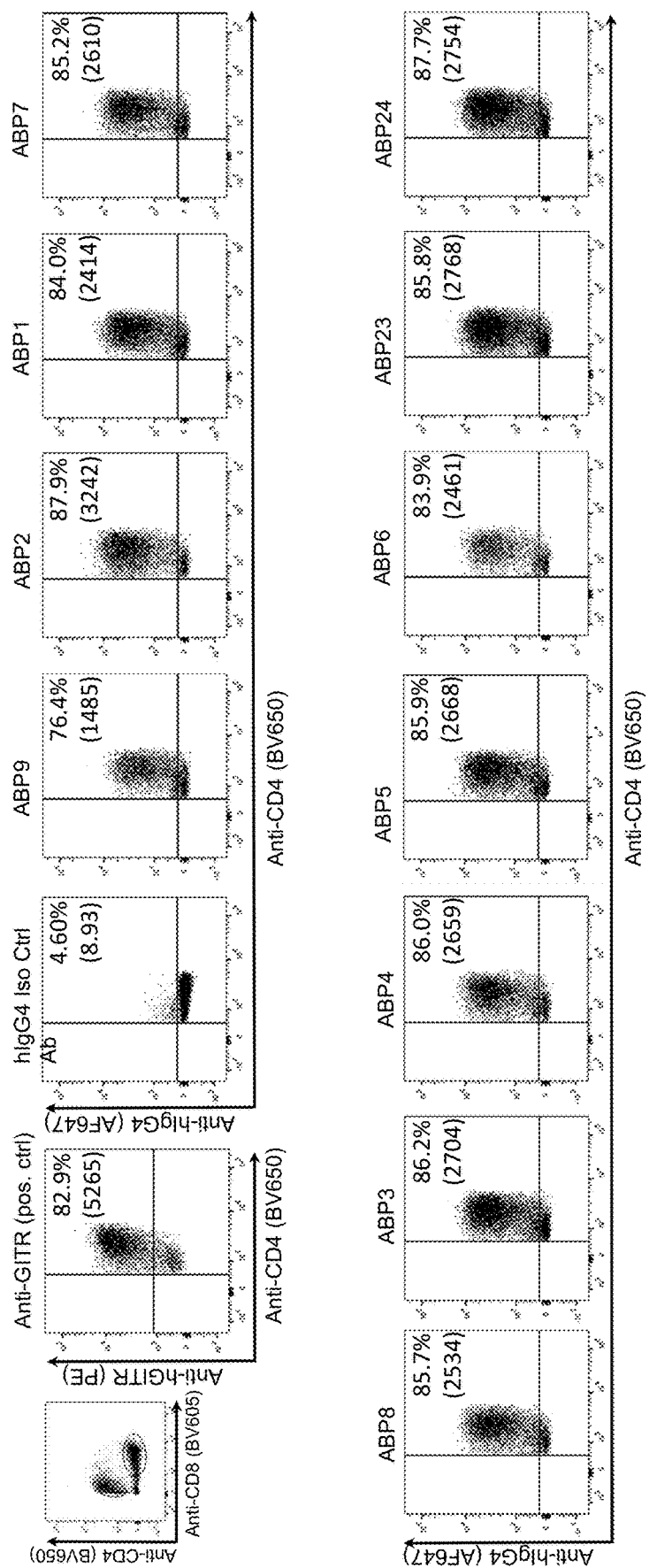
FIG. 3A is a series of graphs showing the results of FACS analysis demonstrating binding of an exemplary panel of N-Terminal Fab TM format ABPs to CD4+ (FIG. 3A) T cells. The distribution of CD4+ and CD8+ is shown in the top left panel of each Figure. In the top row, from left to right, is shown an anti-GITR positive control, and anti-human IgG4 isotype control, ABP9, ABP2, ABP1, and ABP7. On the bottom row is shown ABP8, ABP3, ABP4, ABP5, ABP6, ABP23, and ABP24. The percentage of positively stained IgG4+CD4/8+ cells is indicated; MRI is indicated in brackets.
Figure 3B:
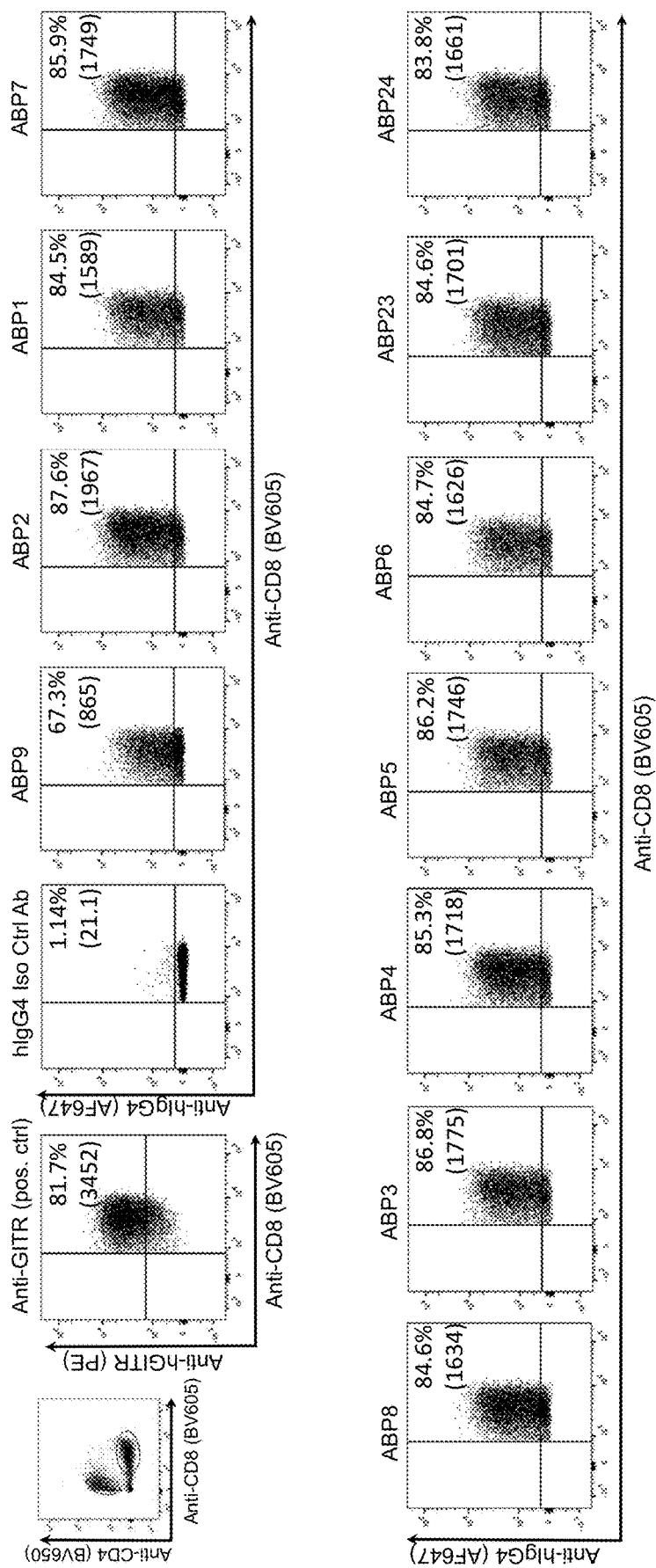
FIG. 3B is a series of graphs showing the results of FACS analysis demonstrating binding of an exemplary panel of N-Terminal Fab TM format ABPs to CD8+ (FIG. 3B) T cells. The distribution of CD4+ and CD8+ is shown in the top left panel of each Figure. In the top row, from left to right, is shown an anti-GITR positive control, and anti-human IgG4 isotype control, ABP9, ABP2, ABP1, and ABP7. On the bottom row is shown ABP8, ABP3, ABP4, ABP5, ABP6, ABP23, and ABP24. The percentage of positively stained IgG4+CD4/8+ cells is indicated; MRI is indicated in brackets.

Exemplary results are shown in FIG. 3. FIG. 3A shows CD4+ cells and FIG. 3B shows CD8+ cells. In the top row, from left to right, is shown an anti-GITR positive control, and anti-human IgG4 isotype control, and N-terminal Fab TM format ABPs ABP9, ABP2, ABP1, and ABP7. On the bottom row is shown ABP8, ABP3, ABP4, ABP5, ABP6, ABP23, and ABP24. The percentage of IgG4+CD4/8+ cells is indicated.

Binding to cell surface human, cynomolgus, and murine GITR is evaluated by transfecting HT1080, CHO, or 293T cells with the respective (human, cynomolgus or murine) GITR. Binding to cynomolgus GITR is further evaluated using primary cynomolgus T cells and the HSC-F T cell line, each after stimulation with anti-CD3 antibody, to increase GITR expression.

Activity Assays for GITR Antigen-Binding Proteins

Figure 4A:
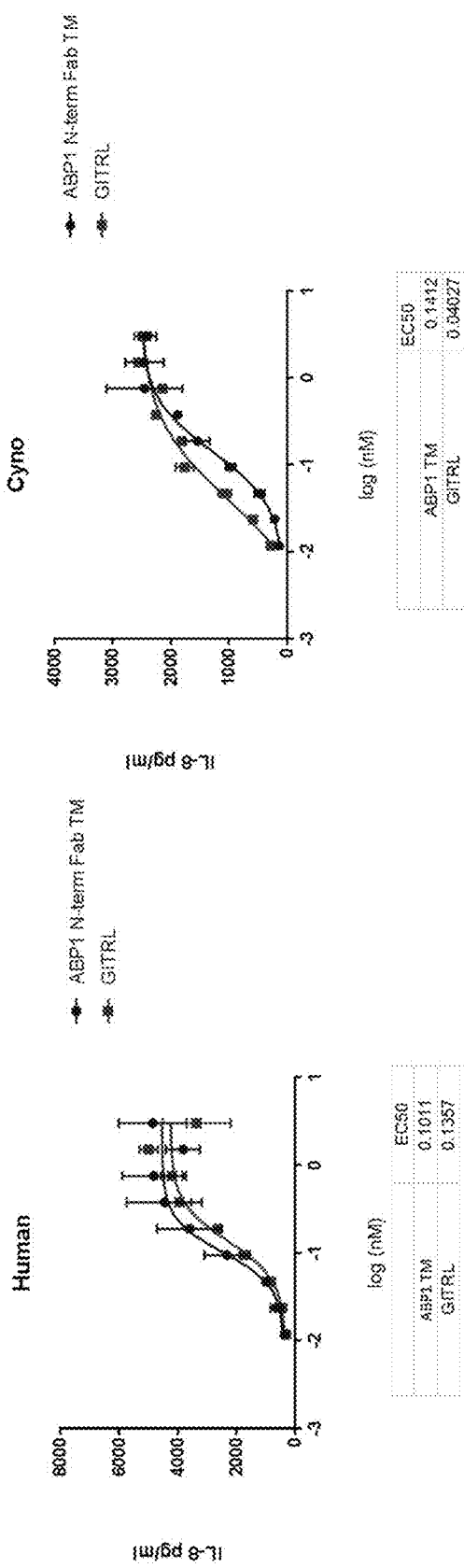
FIG. 4A is graphs showing the activity of eight optimized agonist antibodies in the N-terminal Fab TM format. HT1080 cells that stably express human (left panels) or cynomolgus monkey (right panels) GITR were then incubated with ABP1 (FIG. 4A) (shown as circles in the FIG.), and IL-8 induction was measured. GITRL was used as a control (squares). A table of $EC_{50}$ values is shown on the bottom of each panel.
Figure 4B:
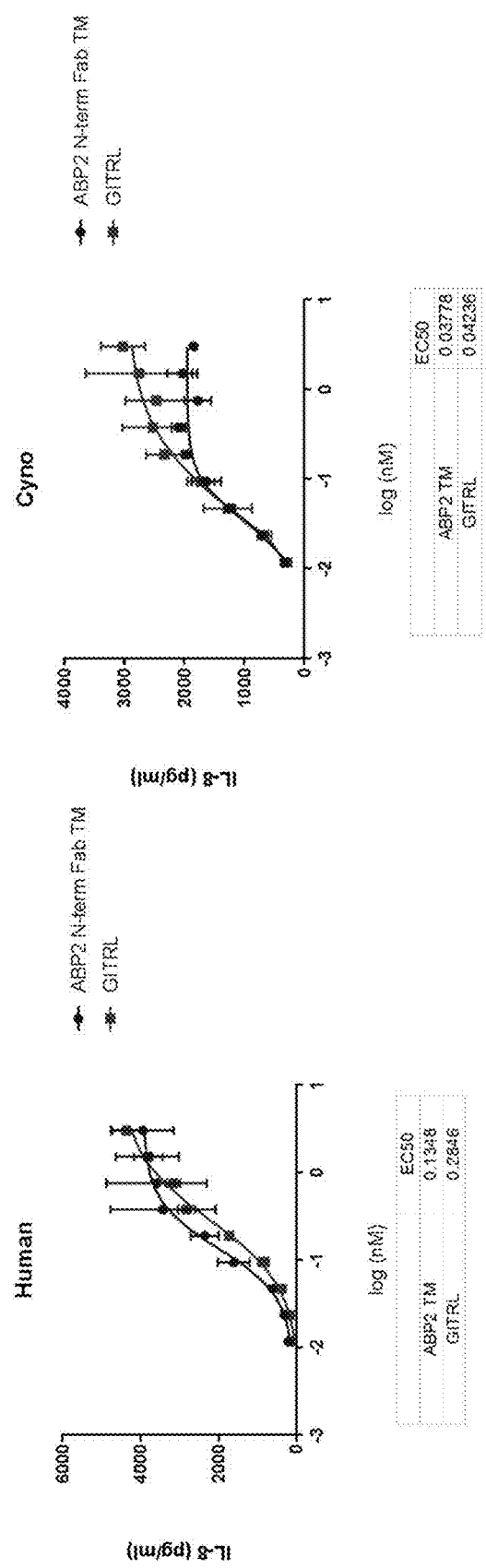
FIG. 4B is graphs showing the activity of eight optimized agonist antibodies in the N-terminal Fab TM format. HT1080 cells that stably express human (left panels) or cynomolgus monkey (right panels) GITR were then incubated with ABP2 (FIG. 4B) (shown as circles in the FIG.), and IL-8 induction was measured. GITRL was used as a control (squares). A table of $EC_{50}$ values is shown on the bottom of each panel.
Figure 4C:
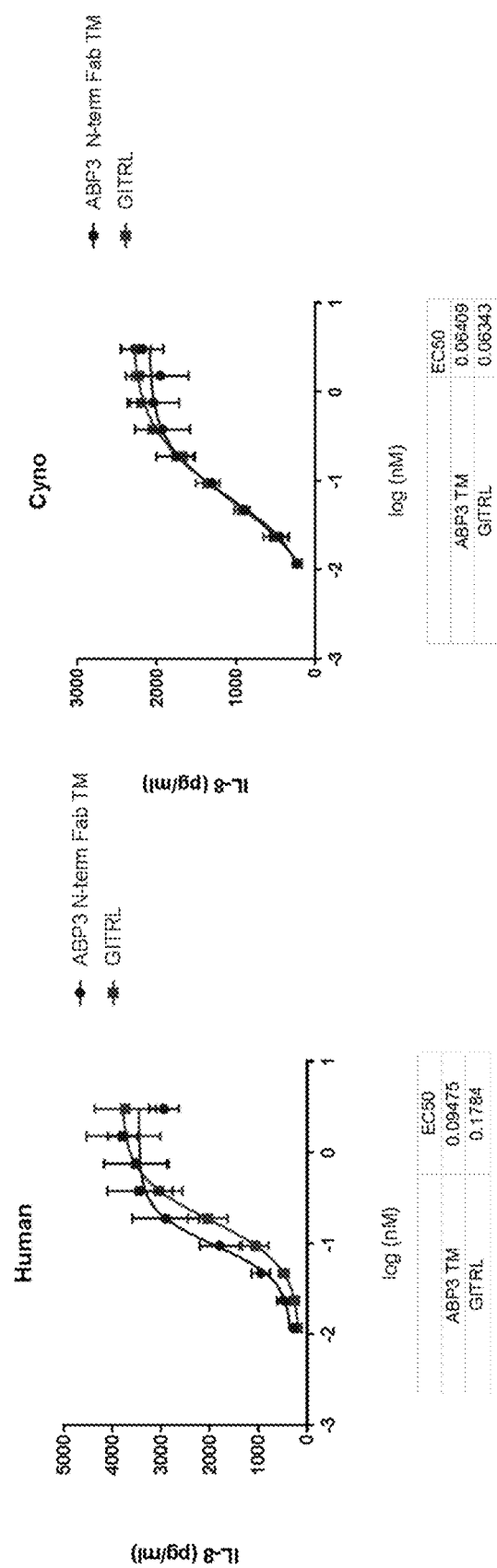
FIG. 4C is graphs showing the activity of eight optimized agonist antibodies in the N-terminal Fab TM format. HT1080 cells that stably express human (left panels) or cynomolgus monkey (right panels) GITR were then incubated with ABP3 (FIG. 4C) (shown as circles in the FIG.), and IL-8 induction was measured. GITRL was used as a control (squares). A table of $EC_{50}$ values is shown on the bottom of each panel.
Figure 4D:
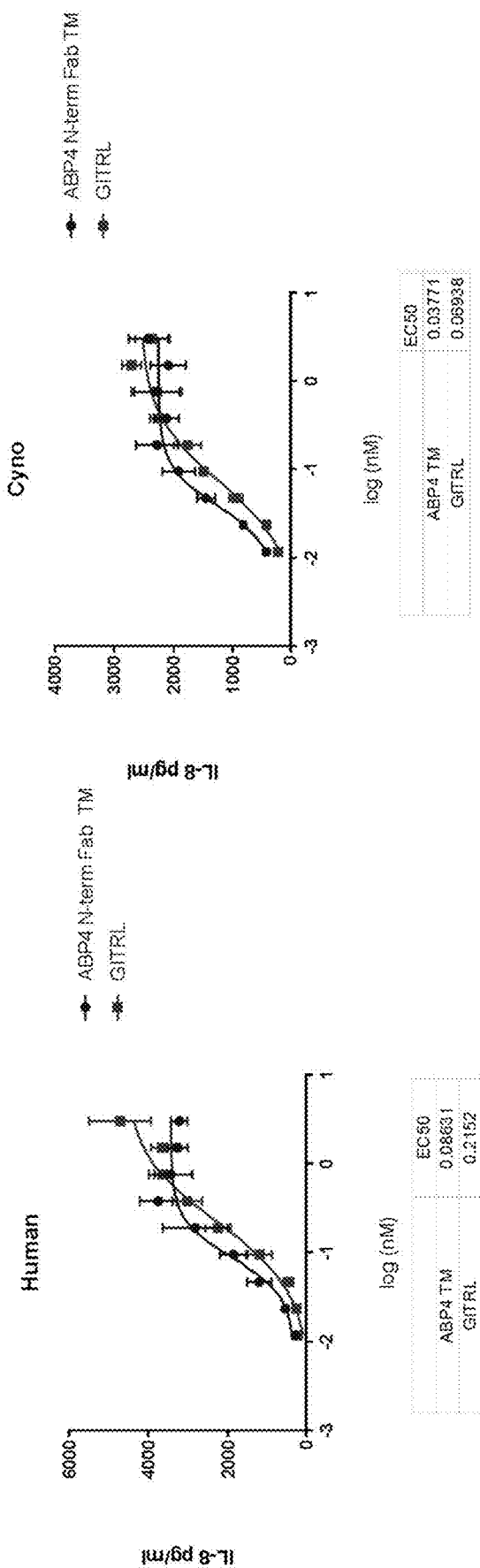
FIG. 4D is graphs showing the activity of eight optimized agonist antibodies in the N-terminal Fab TM format. HT1080 cells that stably express human (left panels) or cynomolgus monkey (right panels) GITR were then incubated with ABP4 (FIG. 4D) (shown as circles in the FIG.), and IL-8 induction was measured. GITRL was used as a control (squares). A table of $EC_{50}$ values is shown on the bottom of each panel.
Figure 4E:
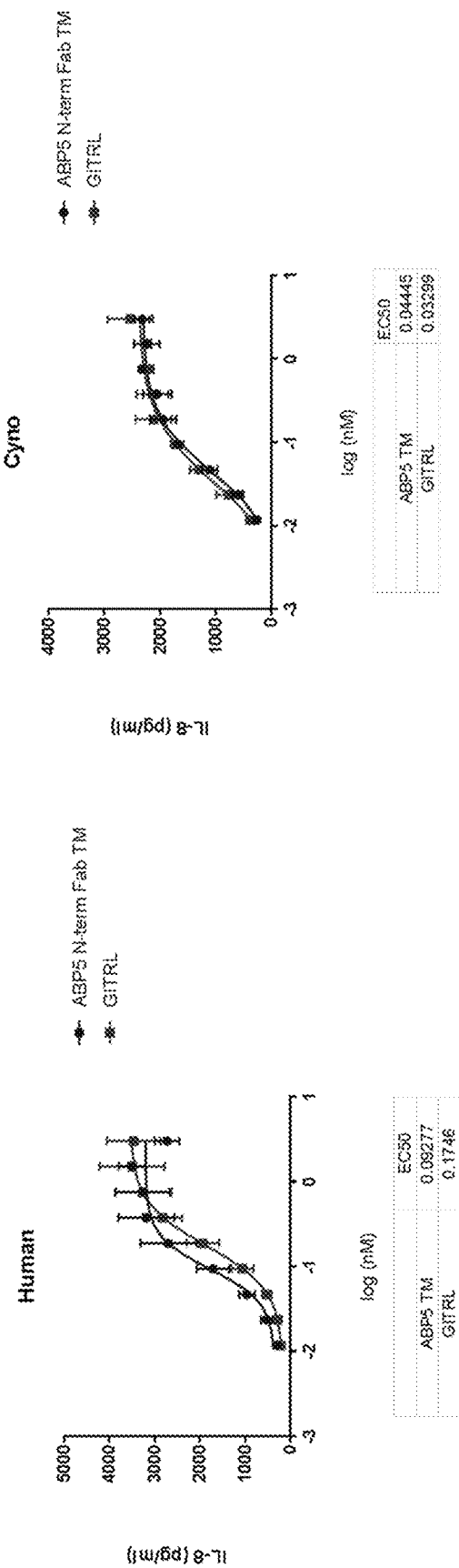
FIG. 4E is graphs showing the activity of eight optimized agonist antibodies in the N-terminal Fab TM format. HT1080 cells that stably express human (left panels) or cynomolgus monkey (right panels) GITR were then incubated with ABP5 (FIG. 4E) (shown as circles in the FIG.), and IL-8 induction was measured. GITRL was used as a control (squares). A table of $EC_{50}$ values is shown on the bottom of each panel.
Figure 4F:
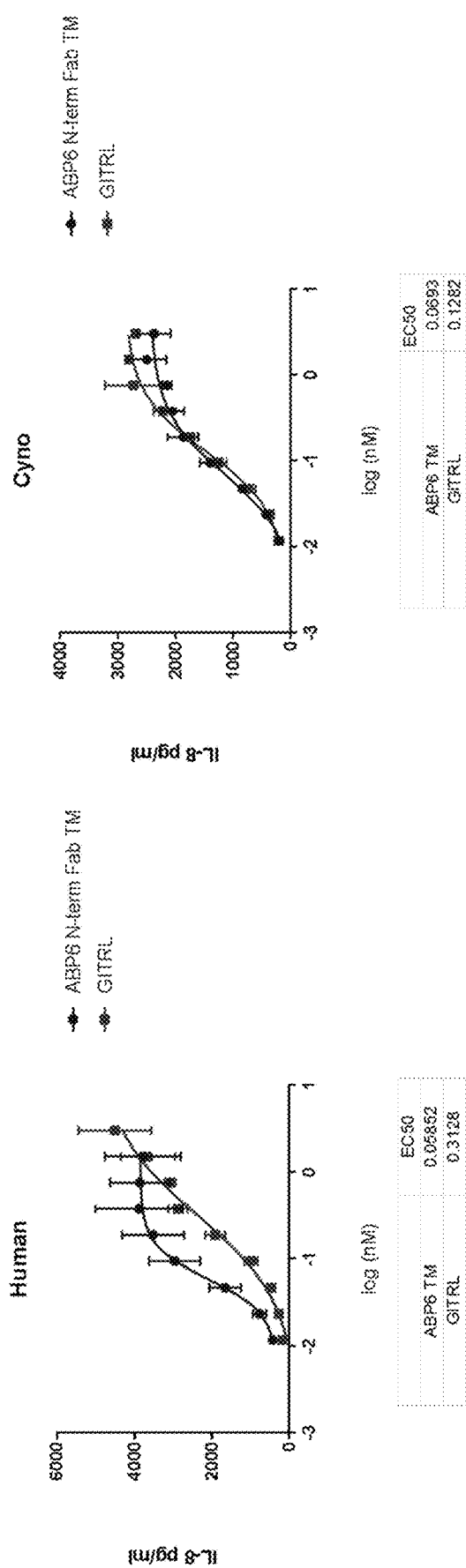
FIG. 4F is graphs showing the activity of eight optimized agonist antibodies in the N-terminal Fab TM format. HT1080 cells that stably express human (left panels) or cynomolgus monkey (right panels) GITR were then incubated with ABP6 (FIG. 4F) (shown as circles in the FIG.), and IL-8 induction was measured. GITRL was used as a control (squares). A table of $EC_{50}$ values is shown on the bottom of each panel.
Figure 4G:
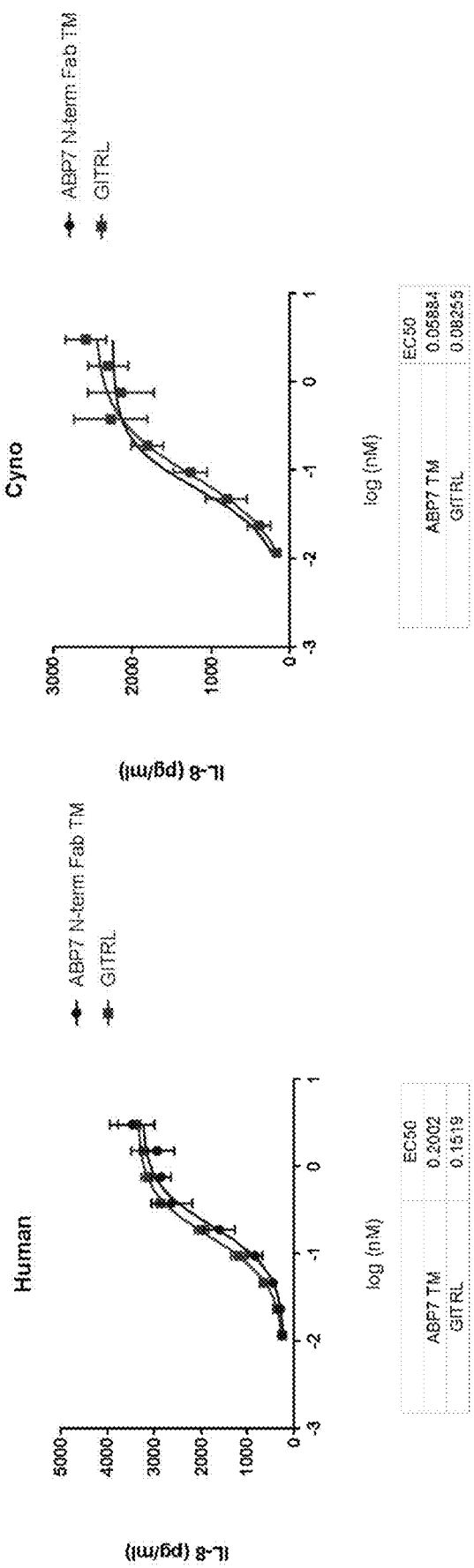
FIG. 4G is graphs showing the activity of eight optimized agonist antibodies in the N-terminal Fab TM format. HT1080 cells that stably express human (left panels) or cynomolgus monkey (right panels) GITR were then incubated with ABP7 (FIG. 4G) (shown as circles in the FIG.), and IL-8 induction was measured. GITRL was used as a control (squares). A table of $EC_{50}$ values is shown on the bottom of each panel.
Figure 4H:
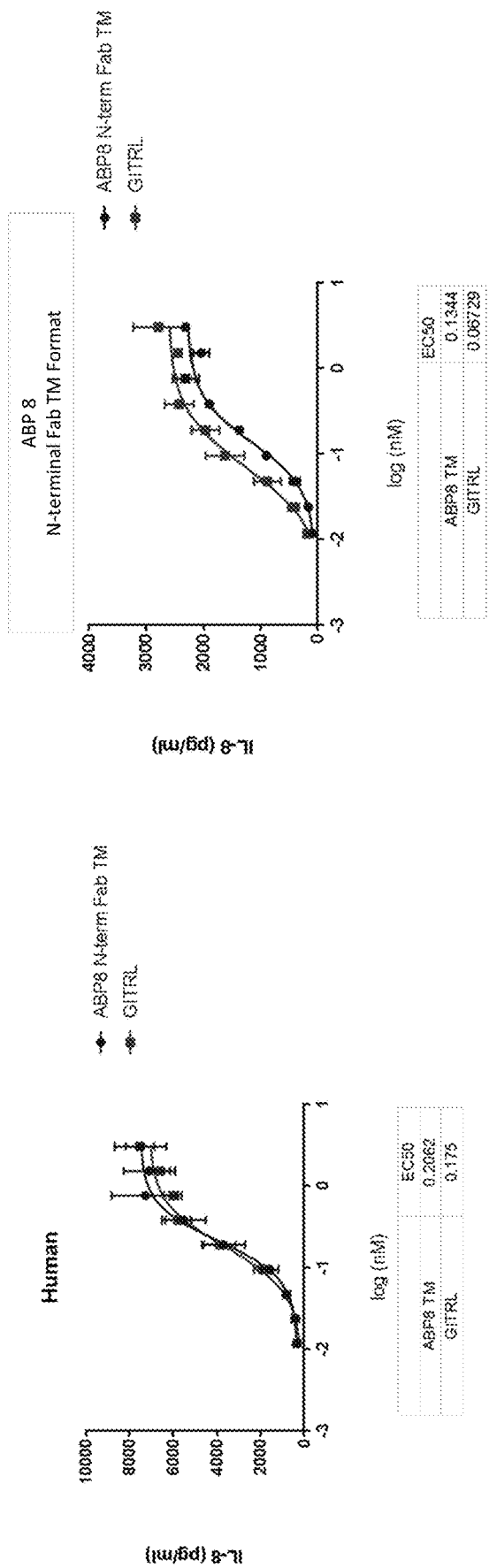
FIG. 4H is graphs showing the activity of eight optimized agonist antibodies in the N-terminal Fab TM format. HT1080 cells that stably express human (left panels) or cynomolgus monkey (right panels) GITR were then incubated with ABP8 (FIG. 4H) (shown as circles in the FIG.), and IL-8 induction was measured. GITRL was used as a control (squares). A table of $EC_{50}$ values is shown on the bottom of each panel.

The GITR ABPs were tested for their ability to agonize GITR. In one assay, HT1080 cells that stably express human or cynomolgus GITR were contacted with TM format GITR ABPs or trimeric human GITRL. After 24 hours, the amount of IL-8 secreted by the cells was evaluated by an ELISA assay. Increased IL-8 secretion corresponds to an increase in GITR agonism. Results for N-terminal Fab TM format antibodies 1-8 are shown in FIG. 4. Shown are the IL-8 output based on antibody or ligand concentration for ABP1 (FIG. 4A), ABP2 (FIG. 4B), ABP3 (FIG. 4C), ABP4 (FIG. 4D), ABP5 (FIG. 4E), ABP6 (FIG. 4F), ABP7 (FIG. 4G), and ABP8 (FIG. 4H). Antibodies shown as circles in the FIGS. and GITRL control is shown as squares. $EC_{50}$ scores are compared to that of GITR ligand (GITRL).

TABLE 8

Agonistic activity of TM Format antibodies on human and cynomolgus GITR on HT1080 cells

| ABP | Average $EC_{50}$ in human HT1080, GITRL on same plate (pM) | % Maximum IL-8 Induction Relative to GITRL in human HT1080, GITRL on same plate | n | Average $EC_{50}$ in cynomolgus HT1080, GITRL on same plate (pM) | % Maximum IL-8 Induction Relative to GITRL in cynomolgus HT1080, GITRL on same plate | n |
|---|---|---|---|---|---|---|
| 1 | 118 | 97 | 2 | 104 | 91 | 2 |
| 2 | 126 | 97 | 2 | 61 | 80 | 2 |
| 3 | 97 | 96 | 2 | 72 | 92 | 2 |
| 4 | 92 | 85 | 2 | 44 | 102 | 2 |
| 5 | 107 | 95 | 2 | 62 | 103 | 2 |
| 6 | 83 | 96 | 2 | 77 | 92 | 2 |
| 7 | 217 | 124 | 2 | 128 | 95 | 2 |
| 8 | 255 | 100 | 2 | 201 | 89 | 2 |
| GITRL | 120 | — | 16 | 76 | — | 16 |

The same assay was conducted using IgG1 N297A non-TM versions of ABPs 1-8 (see FIG. 4) and the data are summarized in Table 9.

TABLE 9

Activity of IgG1 N297A antibodies on human and cynomolgus GITR on HT1080 cells

| ABP (Corresponding TM ABP) | Average $EC_{50}$ in human HT1080, GITRL on 1 separate plate (nM) | n | Average $EC_{50}$ in cynomolgus HT1080, GITRL on 1 separate plate (nM) | n |
|---|---|---|---|---|
| 35 (1) | 0.88 | 1 | 2 | 1 |
| 36 (2) | 0.58 | 1 | 8.8 | 1 |
| 37 (3) | 0.19 | 1 | 1.7 | 1 |
| 38 (4) | 0.33 | 1 | 14.3 | 1 |
| 39 (6) | 0.44 | 1 | 2.3 | 1 |
| 40 (7) | 0.34 | 1 | 1.1 | 1 |
| 41 (8) | 0.44 | 1 | 2 | 1 |
| GITRL | 0.43 | 2 | 0.17 | 2 |

The assay was again used for testing the activity of additional N-terminal Fab and C-terminal Fab TM format antibodies as well the IgG1 N297A versions of those antibodies. The data are summarized in Table 10 and Table 11 and shown in FIG. 5. FIG. 5A shows ABP43 (squares), ABP23 (circles), ABP24 (triangles), and ABP29 (open circles), ABP30 (open triangles), ABP31 (open circles), and ABP32 (open triangles), all in comparison to GITRL (+sign). FIG. 5B shows ABP19 (N-terminal Fab, triangles) and ABP25 (C terminal Fab, upside down triangles). GITRL is shown as plus signs. FIG. 5C shows ABP21 (N-terminal Fab, triangles) and ABP27 (C terminal Fab, upside down triangles). GITRL is shown as plus signs. FIG. 5D shows ABP20 (N-terminal Fab, triangles) and ABP26 (C terminal Fab, upside down triangles). GITRL is shown as plus signs. FIG. 5E shows ABP22 (N-terminal Fab, triangles) and ABP28 (C terminal Fab, upside down triangles). GITRL is shown as plus signs. As shown in the FIG., the N-terminal Fab format ABPs tended to induce more IL-8 than their C-terminal Fab counterparts.

FIG. 10 shows an additional comparison of ABP43 (non-optimized IgG4 format) with two corresponding TM format ABPs where the IgG1 Fab counterpart of ABP43 is added to the N or C terminus of the ABP43. As can be seen in the Figure, the N-terminal Fab TM format ABP9 (squares) induced the most IL-8 (and had the best $EC_{50}$) in comparison to the C-terminal Fab TM format ABP10 (circles) and the non-TM format ABP43 (diamonds). Both TM format ABPs had better activity than the non-TM format parental ABP as well as GITRL. IL-8 induction by GITRL (positive control) is shown as a single data point (star) IL-8 production is shown in pg/mL.

TABLE 10

Agonistic activity of N-terminal Fab and C-terminal Fab TM format antibodies on human GITR on HT1080 cells

| ABP | Format | Average $EC_{50}$ in Human HT1080, GITRL on 1 separate plate (nM) | n |
|---|---|---|---|
| GITRL | — | 0.37 | 1 |
| 9 | N terminal Fab TM | 0.18 | 1 |
| 19 | N terminal Fab TM | 0.25 | 1 |
| 20 | N terminal Fab TM | 0.63 | 1 |
| 21 | N terminal Fab TM | 0.18 | 1 |
| 22 | N terminal Fab TM | 0.30 | 1 |
| 23 | N terminal Fab TM | 0.30 | 1 |
| 24 | N terminal Fab TM | 0.17 | 1 |
| 25 | C terminal Fab TM, linker = 15 mer | 0.46 | |
| 26 | C terminal Fab TM, linker = 15 mer | 0.63 | 1 |
| 27 | C terminal Fab TM, linker = 15 mer | 0.35 | 1 |
| 28 | C terminal Fab TM, linker = 15 mer | 0.63 | 1 |
| 29 | C terminal Fab TM, linker = 15 mer | 0.27 | 1 |
| 30 | C terminal Fab TM, linker = 15 mer | 0.31 | 1 |
| 31 | C terminal Fab TM, linker = 5 mer | 0.18 | 1 |
| 32 | C terminal Fab TM, linker = 5 mer | 0.30 | 1 |

TABLE 11

Agonistic activity of IgG1 N297A antibodies format antibodies on human GITR on HT1080 cells

| ABP | Format | $EC_{50}$ in human HT1080, GITRL on separate plate (nM), n = 2 | $EC_{50}$ in cynomolgus HT1080, GITRL on separate plate (nM), n = 1 |
|---|---|---|---|
| 42 | IgG1 N297A | 17.8 | no activity |
| 44 | IgG1 N297A | 4.2 | 28.0 |
| 45 | IgG1 N297A | 10.5 | 15.1 |
| 46 | IgG1 N297A | 1.2 | 6.9 |
| 47 | IgG1 N297A | 4.1 | 11.8 |
| 48 | IgG1 N297A | 0.8 | minimal activity |
| 49 | IgG1 N297A | 2.7 | 65.8 |

Additional IgG1 N297A versions of H1H2NH optimized antibodies are provided and shown below in Table 12 and their agonistic activity was determined in the HT1080 assay, as described above, is indicated. These antibodies are suitable to be made into TM format.

TABLE 12

Agonistic activity of IgG1 N297A antibodies format antibodies on human GITR on HT1080 cells

| ABP | Format | $EC_{50}$ in human HT1080, GITRL on separate plate (nM) | $EC_{50}$ in cynomolgus HT1080, GITRL on separate plate (nM) |
|---|---|---|---|
| 11 | IgG1 N297A | 3.9 | 21.6 |
| 12 | IgG1 N297A | 3.5 | 28.4 |
| 13 | IgG1 N297A | 7.8 | 15.0 |
| 14 | IgG1 N297A | 0.6 | 4.1 |
| 15 | IgG1 N297A | 0.6 | 4.5 |
| 16 | IgG1 N297A | 0.6 | 3.8 |
| 17 | IgG1 N297A | 5.3 | 8.4 |
| 18 | IgG1 N297A | 2.1 | 13.2 |
| GITRL | — | 0.4 | 0.2 |

A similar assay was performed in Jurkat cells, a T-cell based cell line, engineered to express human GITR and an NF-κB luciferase reporter (Promega®). Eight optimized, N-terminal Fab TM format antibodies, ABPs 1-8, were compared to GITRL for their ability to induce IL-8 in T cells. As shown in FIG. 7A-H (for ABPs 1-8) and Table 13, all eight ABPs were better than GITRL at inducing cytokine production.

TABLE 13

8 Optimized TM format with N-terminal Fab are superior to GITRL

| ABP | EC$_{50}$ (nM) | % Activity Compared to GITRL |
|---|---|---|
| 1 | 0.30 | 104 |
| GITRL | 0.90 | |
| 2 | 0.21 | 114 |
| GITRL | 0.91 | |
| 3 | 0.19 | 120 |
| GITRL | 0.85 | |
| 4 | 0.22 | 117 |
| GITRL | 1.13 | |
| 5 | 0.25 | 104 |
| GITRL | 1.01 | |
| 6 | 0.29 | 121 |
| GITRL | 0.90 | |
| 7 | 0.20 | 108 |
| GITRL | 0.81 | |
| 8 | 0.30 | 114 |
| GITRL | 0.89 | |

Agonistic activity of N-Terminal Fab TM-Format Antibodies in Primary Cells

In one embodiment, the GITR ABPs are further tested for their ability to deliver a co-stimulatory signal to CD4+ CD25-effector T cells in conjunction with TCR signaling via anti-CD3 antibody. Increased T cell activation is measured by quantifying cell proliferation, and/or measuring the increased production and secretion of cytokines including IFN-gamma using an ELISA assay.

In another embodiment, the GITR ABPs are further analyzed to evaluate their ability to prevent the suppression of effector T cells by regulatory T cells. Human CD4+ T cells are isolated using a human CD4+ T cell isolation kit (Miltenyi #130-096). Regulatory T cells are further enriched using human CD25 MicroBeads® II (Miltenyi #130-092-983) following the manufacturer's instructions. The CD25 depleted CD4+ T cells are used as effector T cells in the suppression assay. Beads conjugated to anti-human CD2, CD3, and CD28 antibodies are used to activate the effector T cells in the assay (Treg Suppression Inspector; a.k.a. T cell activation beads, Miltenyi #130-092-909). In a 96-well plate, 50,000 each of regulatory T cells and effector T cells are seeded in each well and incubated with an equal number of T cell activation beads. The mixtures of cells and beads are contacted with different concentrations of GITR ABP for five days. Proliferation of effector T cells is measured by pulsing the cell cultures with tritiated thymidine during the last 16 hours of culture, washing, and measuring the amount of radioactivity incorporated into the cells.

Agonistic activity of N-Terminal Fab TM-Format Antibodies in T-blast Primary Cell Assay Pre-stimulated T cells (T-blasts) were used to assess the activity of eight N-Terminal Fab TM format antibodies (ABPs 1-8).

To generate T-blasts, PBMCs are stimulated with PHA for 5-7 days in order to expand the cells and induce expression of GITR. Cells are washed and frozen prior to the setup of the functional assay.

To assess functional activity of ABPs 1-8, cells are stimulated by adding 1 mg/ml anti-CD3+2 mg/ml anti-CD28, 0.003-10 mg/ml ABPs 1-8, and 10 mg/ml GITRL as a positive control. Cells are incubated at 37° C. and supernatants are collected after 48 hours. IL-2 production is measured by AlphaLISA® (Perkin Elmer®). FIG. 8A shows the percentage of GITR+CD4+ cells (left) and CD8+ cells (right) in cells from two human donors at various time points, +/−stimulation with PHA.

FIGS. 8B-8M show results of treatment of T-blasts from 4 different donors treated with controls or ABPs and the resultant IL-2 production. In each FIG. the top row, from left to right is FACS measurement of ABO binding to CD4+ cells, IL-2 production in cells from Donor 1, IL-2 production in cells from Donor 2. In the bottom row, from left to right, is FACS measurement of ABP binding to CD8+ cells, IL-2 production in cells from Donor 3, IL-2 production in cells from Donor 4. Shown are data as follows: 8B: IgG4 isotype control; 8C: SEC4 antibody; 8D: IgG4 TM format control; 8E: non-TM IgG4 non-optimized lineage parent of ABPs 1-8 (ABP9). 8F: ABP1; 8G: ABP2; 8H: ABP3; 8I: ABP4; 8J: ABP5; 8K: ABP6; 8L: ABP7; 8M: ABP8.

As shown in the FIG., T-blasts from different donors varied in their response to treatment with ABPs 1-8; however, treatment with all eight TM format ABPs had agonistic activity at most concentrations tested, as measured by production of IL-2 and as compared to control antibodies.

GITR Agonistic Activity Comparison of Optimized N-Terminal Fab TM Format ABPs and Non-TM Format IgG1 ABPs The same eight optimized N-terminal Fab TM format ABPs (1-8) as in the above Examples were compared to the non-optimized parental controls in the same IL-8-induction assay described above and shown in FIG. 4. Each FIG. shows a comparison of the N-terminal Fab TM format ABPs 1-8 (IgG4 S228P with N-terminal IgG1 Fab, "IgG4 TM") and the corresponding non-TM format IgG1 (IgG1 N297, "IgG1") ABP, as well GITRL as a positive control and IgG4 negative control (GITRL and IgG4 run on a separate plate from the ABPs). The left panels show results from cells expressing hGITR and the right panels show results from cells expressing cGITR. IL-8 induction as a function of ABP concentration is shown for ABP 1 (FIG. 9A), ABP 2 (FIG. 9B), ABP3 (FIG. 9C), ABP4 (FIG. 9D), ABP5 (FIG. 9E), ABP6 (FIG. 9F), ABP7 (FIG. 9G), and ABP8 (FIG. 9H). Induction of IL-8 by GITRL is shown as circles, by TM format antibodies as triangles, by parental IgG1 antibodies as diamonds, and by IgG4 control antibodies as squares. A table of EC$_{50}$ values is shown on the bottom of each panel of each FIG.

The results shown in FIG. 9 demonstrate that the eight optimized ABPs are able to induce IL-8 production in cells expressing human or cynomolgus GITR to a much greater extent as N-terminal Fab TM format antibodies when compared to bivalent IgG1 N297A. The N-terminal Fab TM format antibodies had smaller EC$_{50}$ values and greater maximum production of IL-8 as compared to the bivalent IgG1 N297A format. In addition, all of the TM antibodies had greater affinity for GITR than the non-TM form of the parental antibody (compare Table 5 and 7 with Table 6).

Evaluation of GITRL Blockade

In another embodiment, GITR blockade was evaluated using a FORTEBIO® OCTET instrument. The analysis was performed at 30° C. using 1× Kinetics Buffer (ForteBio, Inc.) as assay buffer. Anti-human IgG Fc Capture (AHC) biosensors (ForteBio, Inc.) are used to capture human GITR ABPs onto the sensors. Sensors are saturated in assay buffer for 300 seconds before the assay. ABPs were loaded onto sensors by dipping the sensors into ABP supernatant solution for 300 seconds. Baseline was established by dipping the sensors into 1× assay buffer for 200 seconds. Next, association of recombinant GITR was monitored for 180 seconds. The ability of recombinant GITRL to then associate with the ABP/GITR complex was the determined by dipping the sensors in GITRL for 180 seconds.

GITR blockade was evaluated according to the methods above using ABPs 1-8. All eight ABPs were capable of blocking GITRL binding.

In one embodiment, to evaluate whether anti-human GITR ABPs block GITR ligand (GITRL, R&D Systems #6987-GL-CF) binding to GITR, various concentrations of unlabeled GITR ABP are incubated with human pan T cells at 4° C. in staining buffer (e.g., phosphate buffered saline with 0.5% bovine serum albumin) for 10 min. Without washing, 4 nM of HA-tagged human GITRL is added and incubated at 4° C. for another 30 min. The cells are then washed twice with staining buffer, and incubated with anti-HA PE antibody (Miltenyi #130-092-257) in staining buffer at 4° C. for 30 min. The cells are then washed twice with staining buffer and fixed with 2% paraformaldehyde in PBS for flow cytometry analysis. A decrease in the amount of PE staining indicates that the ABP blocks the GITR-GITRL interaction.

Example 3: Multispecific Antigen-Binding Proteins

One embodiment of multispecific GITR agonistic ABPs comprises a common light chain antibody. ABPs were identified that bind two distinct epitopes on GITR. These two ABPs share the same light chain. ABP61 is an agonistic antibody and ABP59 has less agonistic activity but does not compete with ABP61 for binding to GITR. Multivalent multispecific antibodies with common light chains were produced by transfecting a HEK-293 host cell with vectors encoding two heavy chains and the single common light chain. The first exemplary ABP disclosed herein with a common light chain (SEQ ID NO:125) is ABP33, which has an IgG4 heavy chain (ABP61) with N-terminal Fab (from ABP58 (IgG1 counterpart of ABP59)), and the full-length sequence SEQ ID NO:124 (HC) and SEQ ID NO:125 (LC). The second exemplary ABP disclosed herein with a common light chain is ABP34, which has a IgG4 heavy chain (ABP61) with C-terminal Fab (from ABP58 (IgG1 counterpart of ABP59), and the full-length sequence SEQ ID NO:136 (HC) and SEQ ID NO:125 (LC).

Each multispecific ABP binds two distinct epitopes on GITR. The ABPs are characterized as described in the Examples above. Other multispecific ABPs described herein are produced and similarly characterized. FIG. 6 shows the results of $EC_{50}$ determination for ABP33 and ABP34 in the HT1080 assay as described above in Example 2. ABP33 (tetravalent version combining the IgG4 ABP61 with the IgG1 Fab of ABP58 [IgG1 counterpart of ABP59] on the N-terminus) and ABP34 (tetravalent version combining the IgG4 of ABP61 with the IgG1 Fab of ABP58 [IgG1 counterpart of ABP59] on the C-terminus) were compared to bivalent ABPs 59 and 61 (IgG4 S228P). As shown in the FIG., the tetravalent antibodies both had superior $EC_{50}$, as measured by IL-8 induction, when compared to their bivalent counterparts.

Example 4: Comparison of TM-Format Antibodies to Benchmark Anti-GITR Antibodies

The activity of N-terminal Fab TM-format antibodies was tested against two known anti-GITR antibodies, SEC4 and SEC9 in HT1080 cells that were engineered to stably express human GITR. Cultured cells were treated for six hours with a range of concentrations of two benchmark agonist antibodies SEC4 ("35E6" formatted to have mouse variable regions with human IgG4 S228P/kappa regions, orange diamonds) and SEC9 (humanized 6C8 N62Q IgG1 N297A). SEC4 is described, e.g., in U.S. Pat. No. 8,709,424; variable regions are found in SEQ ID NOs 1 and 12. SEC9 is described, e.g., in U.S. Pat. No. 7,812,135; full length sequences are set forth in SEQ ID NOs 58 and 63. A bivalent antibody dose of 1 μg/ml is equivalent to 6.67 nM; a tetravalent antibody dose of 1 μg/ml is equivalent to 4 nM.

Induction of IL-8 was measured by ELISA and the $EC_{50}$ was calculated. FIG. 11A shows a comparison of hGITRL to SEC4 (diamonds) and SEC9 (circles), as well as an IgG4 negative control (closed triangles), an IgG1 negative control (open triangles), and trimeric human GITR ligand ("hGITRL", squares) as a positive control. GITRL had a better $EC_{50}$ (inset) and max induction compared to both SEC4 and SEC9.

Also shown are comparisons to GITRL with ABP1 (FIG. 11B), ABP2 (FIG. 11C), ABP3 (FIG. 11D), ABP4 (FIG. 11E), ABP5 (FIG. 11F), ABP6 (FIG. 11G), ABP7 (FIG. 11H), and ABP8 (FIG. 11I). As shown in the Figure, all eight N-Terminal Fab TM format antibodies had a more favorable $EC_{50}$ than did either SEC4 or SEC9. All eight N-Terminal Fab TM format antibodies also had a greater induction of IL-8 production than either SEC4 or SEC9.

SEC4 was also tested as described above in the T-blast primary cell assay. As shown in FIG. 8, induction of IL-2 in primary cells by SEC4 was less for all four donors than that of the TM format antibodies.

Example 5: Anti-GITR ABPs Increase Production of Cytokines in Patient Tumor Infiltrating Lymphocytes and GITR+ T Cells Materials and Methods Dissociated human tumor samples were purchased from Conversant Bio. Samples were NSCLC adenocarcinoma isolated from a 75-year-old male, a previous smoker, with Stage Ia disease, prior to any treatment. The sample was quickly thawed, then restimulated with several conditions, with and without immunotherapies as follows: cells were either unstimulated controls, or were stimulated with 1 μg/mL αCD3 (Soluble)+2 μg/mL αCD28 (Soluble)+IL-2 (50 ng/mL); cells either received no immunotherapy treatment (for assessment of checkpoint protein levels), pembrolizumab (10 μg/mL), TM format ABP control (2 μg/mL), ABP1 (2 μg/mL), or ABP1+pembrolizumab. Cells were incubated for 48 hours before supernatants were collected and stained for expression of checkpoints. In some samples, brefeldin A (an inhibitor of cytokine secretion) was added to the last five hours of stimulation for detection of cytokines by intracellular cytokine staining.

Results

Cells were gated on GITR-positive T cells and the results are shown in FIG. 12A (TNF production) and FIG. 12B (IFNγ production). As shown in the Figures, anti-GITR (ABP1) single agent treatment resulted in an increase in cytokine production. There was not a significant increase in this assay of cytokine production in cells receiving the combination ABP1+pembrolizumab treatment.

Example 6: Mutational Analysis for Epitope Determination: Alanine Scanning

To identify the epitope for ABP1 binding to human GITR, single point mutations were made in the human GITR extra cellular domain to determine if APB1 binding was reduced. Either alanine substitutions or murine specific residues were used (ABP1 does not bind mouse GITR). Proteins were expressed in HEK-293 cells with an Fc tag, secreted as soluble protein, purified on MabSelect® Sure® Lx resin, and characterized by SDS-PAGE. Binding was assessed by Bio-Layer Interferometry (BLI) using the Octet platform. Wild type human GITR-Fc or GITR-Fc mutant was captured on anti-human Fc sensors, washed, and exposed to ABP1 Fab. Residues considered part of the binding epitope demonstrated reduced or no binding (e.g., a $K_D$ more than 3-fold poorer than that of binding to wild type human GITR). Alanine substitution at residues C58, R59, Y61, E64, C67 and an aspartic acid substitution at position C66 resulted in no binding, while alanine substitution at residues R56, D60, P62 or E65 resulted in reduced binding.

Example 7: In Vivo Evaluation of GITR Antigen-Binding Proteins

In vivo studies are performed to demonstrate the capability of the ABPs to decrease circulating regulatory T cell numbers in a humanized NSG mouse model. Neonate NSG mice are transplanted with CD34+ human fetal liver cells by retro-orbital injection. Over 16 weeks, the animals develop a diverse human immune cell repertoire including CD4+ and CD8+ effector T cells, and regulatory T cells. A single intraperitoneal dose of 25 mg/kg anti-human GITR ABP or human isotype control is given to the mice and the percent of circulating human CD4+ T cells expressing the regulatory T cell marker FoxP3 is determined by flow cytometry on day 4 after dosing.

Example 8. Incubation of Activated T Cells with TM Format ABP1 or its Conventional Format Parent ABP35

Preparation of Activated T Blasts

Activated T blasts were generated by stimulating freshly isolated PBMCs from two healthy donors for 7 days with PHA (final conc. 10 μg/ml) and IL-2 (final conc. 4 ng/ml, added only during last 24 h) at 37° C. & 5% $CO_2$.
Internalization of GITR after Antibody Binding Activated CD4+/CD8+T blasts were seeded at $2 \times 10^5$ per well in 96-well U bottom plates. Wells were treated with medium alone, recombinant GITR-Ligand (10 μg/ml, R&D Systems, Cat #6987-GL-025/CF), ABP1 (~250 kDa), hIgG4 TM Format isotype control, ABP35 (~150 kDa), or hIgG1 standard format isotype control at nine doses each: 10 μg/mL, 2 μg/mL, 0.4 μg/mL, 80 ng/mL, 16 ng/mL, 3.2 ng/mL, 0.64 ng/mL, 0.13 ng/mL, and 0.026 ng/mL.
Internalization of GITR after Antibody Binding Antibody-mediated clustering promotes endocytosis and signaling of TNF receptor superfamily members such as GITR. The ability of ABP1 and ABP35 (as well as the isotype controls) to mediate clustering and internalization was measured.

The activated T blasts were first stained for FACS sorting. Fc receptors were blocked with human TruStain® FcX for 10 minutes at room temperature. Cells were incubated with fluorescent-conjugated antibodies for 30 minutes at 4° C. as in Table 14. Cells were then washed 2× with FACS buffer, fixed in paraformaldehyde for 30 minutes in the dark, washed again, and resuspended in 200 FACS buffer and acquired on a BD Fortessa instrument.

GITR internalization was measured in CD4+ cells (FIGS. 13A-E) and CD8+ cells (FIGS. 13F-J) from either Donor 1 (FIGS. 13A-B, 13F-G) or Donor 2 (FIGS. 13C-D, 13H-I). Cells were treated with either ABP1 TM format antibody or ABP35 standard bivalent antibody. As can be observed, incubation with either ABP1 or ABP35 inhibits the subsequent staining with ABP1Dylight650 (FIGS. 13A, 13C, 13F, 13H) but only incubation with ABP1 induces GITR internalization as measured by staining with non-competitive clone 108-17 (FIGS. 13B, 13D, 13G, 13I). A determination of the $EC_{50}$ of ABP1 on cells from both donors is shown in FIG. 13E (CD4+ cells) and FIG. 13J (CD8+ cells).

TABLE 14

| Fluorochrome labeling | | | |
|---|---|---|---|
| Antigen | Clone | Isotype control | Fluorochrome |
| CD3 | UCHT-1 | — | PE/Cy 7 |
| CD4 | OKT4 | — | BV421 |
| CD8 | RPA-T8 | — | FITC |
| GITR | "ABP1" | hIgG4 TM format | Dylight-650 |
| GITR | 108-17 | mIgG2a | BV605 |

Cytokine Production in Activated T Cells Treated with ABP1 or ABP35

Activated CD4+/CD8+T blasts were seeded at $5 \times 10^4$ per well in 96-well U bottom plates. Wells were treated with medium alone, recombinant GITR-Ligand (10 μg/ml, R&D Systems, Cat #6987-GL-025/CF), ABP1, hIgG4 TM Format isotype control, ABP35, or hIgG1 standard format isotype control at nine doses each: 10 μg/mL, 2 μg/mL, 0.4 μg/mL, 80 ng/mL, 16 ng/mL, 3.2 ng/mL, 0.64 ng/mL, 0.13 ng/mL, and 0.026 ng/mL.

Cells were stimulated by adding 1 μg/ml anti-CD3 antibodies (mouse anti-human, clone UCHT-1), R&D Systems, Cat #MAB100) and 2 μg/ml anti-CD28 (mouse anti-human, clone 37407), R&D Systems, Cat #MAB342) antibodies. Assays were incubated at 37° C. & 5% CO2 for 48 h. IL-2 production was measured by AlphaLISA® (Perkin Elmer).

Incubation of T blasts with the TM format antibody ABP1, but not the same antibody in standard bivalent format (ABP35) or either of the isotype controls, leads to internalization of GITR by activated CD4+ and CD8+ T cells (FIG. 13).

In addition, superclustering of the GITR receptor by ABP1, but not binding by a conventional bivalent ABP, promotes IL-2 secretion by activated T blasts in a dose-dependent manner (FIG. 14). Together, these data show that T blasts that don't respond to conventional anti-GITR therapy will respond to the corresponding TM format antibody.

Example 9: Cytokine Production in Activated T Cells Treated with ABP1 in Comparison with Two Benchmark Antibodies, SEC4 and SEC9

Activated T blasts were prepared as described in Example 8, and used to compare the activity of ABP1 with benchmark anti-GITR antibodies SEC4 and SEC9. Activated T blasts were generated by stimulating freshly isolated PBMCs from two healthy donors for 7 days with PHA (final conc. 10 μg/ml) and IL-2 (final conc. 4 ng/ml, added only during last 24 h) at 37° C. & 5% CO2.

Activated CD4+/CD8+T blasts were seeded at $5 \times 10^4$ per well in 96-well U bottom plates. Wells were treated with medium alone, recombinant GITR-Ligand, ABP1, SEC4, SEC9, hIgG4 TM Format isotype control ("IsoTM"), hIgG1 standard format isotype control, and hIgG4 standard format isotype control, at nine doses each: 10 μg/mL, 2 μg/mL, 0.4 μg/mL, 80 ng/mL, 16 ng/mL, 3.2 ng/mL, 0.64 ng/mL, 0.13 ng/mL, and 0.026 ng/mL.

Cytokine Production in Activated T Cells Treated with ABP1, SEC4, and SEC9

Cells were stimulated by adding 1 μg/ml anti-CD3 antibodies and 2 μg/ml anti-CD28 antibodies. Cells were incubated at 37° C. & 5% CO2 for 48 h. IL-2 production was measured by AlphaLISA® (Perkin Elmer). As seen in Example 8, TM format ABP1 promotes IL-2 secretion by activated T blasts in a dose-dependent manner. IL-2 production from activated T cells is shown in FIG. 15A (Donor 1) and 15B (Donor 2). The corresponding $EC_{50}$ is shown in FIG. 15C (Donor 1) and 15D (Donor 2).

As can be seen in the Figures, SEC4 and SEC9 don't induce IL-2 efficiently in a dose dependent manner, ABP1 did induce IL-2 production to a greater extent than SEC4 and SEC9 in a clear dose dependent manner. Together, these data support that T blasts that don't respond to conventional anti-GITR therapy will respond to the corresponding TM format antibody.

EQUIVALENTS

The disclosure set forth above may encompass multiple distinct inventions with independent utility. Although each of these inventions has been disclosed in its preferred form(s), the specific embodiments thereof as disclosed and illustrated herein are not to be considered in a limiting sense, because numerous variations are possible. The subject matter of the inventions includes all novel and nonobvious combinations and subcombinations of the various elements, features, functions, and/or properties disclosed herein. The following claims particularly point out certain combinations and subcombinations regarded as novel and nonobvious. Inventions embodied in other combinations and subcombinations of features, functions, elements, and/or properties may be claimed in this application, in applications claiming priority from this application, or in related applications. Such claims, whether directed to a different invention or to the same invention, and whether broader, narrower, equal, or different in scope in comparison to the original claims, also are regarded as included within the subject matter of the inventions of the present disclosure.

APPENDIX A

SEQUENCES

| SEQ ID NO | Molecule | Description | SEQUENCE |
|---|---|---|---|
| 1 | Human GITR | NP_004186.1 (ref seq) or Q9Y5U5 (UniProt) | MAQHGAMGAFRALCGLALLCALSLGQRPTGGPGCGPGRLLLG TGTDARCCRVHTTRCCRDYPGEECCSEWDCMCVQPEFHCGDPC CTTCRHHPCPPGQGVQSQGKFSFGFQCIDCASGTFSGGHEGHCK PWTDCTQFGFLTVFPGNKTHNAVCVPGSPPAEPLGWLTVVLLA VAACVLLLTSAQLGLHIWQLRSQCMWPRETQLLLEVPPSTEDA RSCQFPEEERGERSAEEKGRLGDLWV |
| 2 | Human GITR T43R SNP variant | | MAQHGAMGAFRALCGLALLCALSLGQRPTGGPGCGPGRLLLG RGTDARCCRVHTTRCCRDYPGEECCSEWDCMCVQPEFHCGDP CCTTCRHHPCPPGQGVQSQGKFSFGFQCIDCASGTFSGGHEGHC KPWTDCTQFGFLTVFPGNKTHNAVCVPGSPPAEPLGWLTVVLL AVAACVLLLTSAQLGLHIWQLRSQCMWPRETQLLLEVPPSTED ARSCQFPEEERGERSAEEKGRLGDLWV |
| 3 | Cynomolgus monkey GITR | XP_005545180.1 | MCACGTLCCLALLCAASLGQRPTGGPGCGPGRLLLGTGKDARC CRVHPTRCCRDYQSEECCSEWDCVCVQPEFHCGNPCCTTCQHH PCPSGQGVQPQGKFSFGFRCVDCALGTFSRGHDGHCKPWTDCT QFGFLTVFPGNKTHNAVCVPGSPPAEPPGWLTIVLLAVAACVLL LTSAQLGLHIWQLGSQPTGPRETQLLLEVPPSIEDASSCQFPEEE RGERLAEEKGRLGDLWV |
| 4 | Mouse GITR | | MGAWAMLYGVSMLCVLDLGQPSVVEEPGCGPGKVQNGSGNN TRCCSLYAPGKEDCPKERCICVTPEYHCGDPQCKICKHYPCQPG QRVESQGDIVFGFRCVACAMGTFSAGRDGHCRLWTNCSQFGFL TMFPGNKTHNAVCIPEPLPTEQYGHLTVIFLVMAACIFFLTTVQL GLHIWQLRRQHMCPRETQPFAEVQLSAEDACSFQFPEEERGEQT EEKCHLGGRWP |
| 5 | Linker 1 | | GGGGS |
| 6 | Linker 2 | | GGGGSGGGGSGGGGS |
| 7 | ABP1 | Heavy Chain Full, heavy variable 1 + IgG1 CH1 + GGGGS (SEQ ID NO: 5) + heavy variable 1 + IgG4 S228P (with or without C terminal Lys) | QVQLQESGPGLVKPSETLSLTCAVSGYSISSGLGWGWIRQPPGK GLEWIGGIYESGSTYYNPSLKSRVTISVDTSKNQFSLKLSSVTAA DTAVYYCAHERVRGYGDYGGHHAFDIWGQGTMVTVSSASTKG PSVFPLAPSSKSTSGGTAALGCLVKDYFPEPVTVSWNSGALTSG VHTFPAVLQSSGLYSLSSVVTVPSSSLGTQTYICNVNHKPSNTKV DKRVEPKSCGGGGSQVQLQESGPGLVKPSETLSLTCAVSGYSISS GLGWGWIRQPPGKGLEWIGGIYESGSTYYNPSLKSRVTISVDTS KNQFSLKLSSVTAADTAVYYCAHERVRGYGDYGGHHAFDIWG QGTMVTVSSASTKGPSVFPLAPCSRSTSESTAALGCLVKDYFPEP VTVSWNSGALTSGVHTFPAVLQSSGLYSLSSVVTVPSSSLGTKT YTCNVDHKPSNTKVDKRVESKYGPPCPPCPAPEFLGGPSVFLFPP KPKDTLMISRTPEVTCVVVDVSQEDPEVQFNWYVDGVEVHNA KTKPREEQFNSTYRVVSVLTVLHQDWLNGKEYKCKVSNKGLPS SIEKTISKAKGQPREPQVYTLPPSQEEMTKNQVSLTCLVKGFYPS |

APPENDIX A-continued

SEQUENCES

| SEQ ID NO | Molecule | Description | SEQUENCE |
|---|---|---|---|
| | | | DIAVEWESNGQPENNYKTTPPVLDSDGSFFLYSRLTVDKSRWQE GNVFSCSVMHEALHNHYTQKSLSLSLGK |
| 221 | ABP2 | Heavy Chain Full, heavy variable 1 + IgG1 CH1 + GGGGS (SEQ ID NO: 5) + heavy variable 1 + IgG4 S228P (with or without C terminal Lys) | QVQLQESGPGLVKPSQTLSLTCTVSGGSISSGGAVWSWIRQHPG KGLEWIGGIAYSGSTYYNPSLKSRVTISVDTSKNQFSLKLSSVTA ADTAVYYCADENVRGYGDYGGHHAFDIWGQGTMVTVSSAST KGPSVFPLAPSSKSTSGGTAALGCLVKDYFPEPVTVSWNSGALT SGVHTFPAVLQSSGLYSLSSVVTVPSSSLGTQTYICNVNHKPSNT KVDKRVEPKSCGGGGSQVQLQESGPGLVKPSQTLSLTCTVSGGS ISSGGAVWSWIRQHPGKGLEWIGGIAYSGSTYYNPSLKSRVTISV DTSKNQFSLKLSSVTAADTAVYYCADENVRGYGDYGGHHAFDI WGQGTMVTVSSASTKGPSVFPLAPCSRSTSESTAALGCLVKDYF PEPVTVSWNSGALTSGVHTFPAVLQSSGLYSLSSVVTVPSSSLGT KTYTCNVDHKPSNTKVDKRVESKYGPPCPPCPAPEFLGGPSVFL FPPKPKDTLMISRTPEVTCVVVDVSQEDPEVQFNWYVDGVEVH NAKTKPREEQFNSTYRVVSVLTVLHQDWLNGKEYKCKVSNKG LPSSIEKTISKAKGQPREPQVYTLPPSQEEMTKNQVSLTCLVKGF YPSDIAVEWESNGQPENNYKTTPPVLDSDGSFFLYSRLTVDKSR WQEGNVFSCSVMHEALHNHYTQKSLSLSLGK |
| 24 | ABP3 | Heavy Chain Full, heavy variable 1 + IgG1 CH1 + GGGGS (SEQ ID NO: 5) + heavy variable 1 + IgG4 S228P (with or without C terminal Lys) | QVQLQESGPGLVKPSETLSLTCAVSGYSISSGAGWGWIRQPPGK GLEWIGLIVHSGSTYYNPSLKSRVTISVDTSKNQFSLKLSSVTAA DTAVYYCVLESVRGYGDYGGHHAFDIWGQGTMVTVSSASTKG PSVFPLAPSSKSTSGGTAALGCLVKDYFPEPVTVSWNSGALTSG VHTFPAVLQSSGLYSLSSVVTVPSSSLGTQTYICNVNHKPSNTKV DKRVEPKSCGGGGSQVQLQESGPGLVKPSETLSLTCAVSGYSISS GAGWGWIRQPPGKGLEWIGLIVHSGSTYYNPSLKSRVTISVDTS KNQFSLKLSSVTAADTAVYYCVLESVRGYGDYGGHHAFDIWG QGTMVTVSSASTKGPSVFPLAPCSRSTSESTAALGCLVKDYFPEP VTVSWNSGALTSGVHTFPAVLQSSGLYSLSSVVTVPSSSLGTKT YTCNVDHKPSNTKVDKRVESKYGPPCPPCPAPEFLGGPSVFLFPP KPKDTLMISRTPEVTCVVVDVSQEDPEVQFNWYVDGVEVHNA KTKPREEQFNSTYRVVSVLTVLHQDWLNGKEYKCKVSNKGLPS SIEKTISKAKGQPREPQVYTLPPSQEEMTKNQVSLTCLVKGFYPS DIAVEWESNGQPENNYKTTPPVLDSDGSFFLYSRLTVDKSRWQE GNVFSCSVMHEALHNHYTQKSLSLSLGK |
| 32 | ABP4 | Heavy Chain Full, heavy variable 1 + IgG1 CH1 + GGGGS (SEQ ID NO: 5) + heavy variable 1 + IgG4 S228P (with or without C terminal Lys) | QVQLQESGPGLVKPSETLSLTCAVSGYSISSGAGWGWIRQPPGK GPEWIGLIVHSGSTYYNPSLKSRVTISVDTSKNQFSLKLSSVTAA DTAVYYCVLESVRGYGDYGGHHAFDIWGQGTMVTVSSASTKG PSVFPLAPSSKSTSGGTAALGCLVKDYFPEPVTVSWNSGALTSG VHTFPAVLQSSGLYSLSSVVTVPSSSLGTQTYICNVNHKPSNTKV DKRVEPKSCGGGGSQVQLQESGPGLVKPSETLSLTCAVSGYSISS GAGWGWIRQPPGKGPEWIGLIVHSGSTYYNPSLKSRVTISVDTS KNQFSLKLSSVTAADTAVYYCVLESVRGYGDYGGHHAFDIWG QGTMVTVSSASTKGPSVFPLAPCSRSTSESTAALGCLVKDYFPEP VTVSWNSGALTSGVHTFPAVLQSSGLYSLSSVVTVPSSSLGTKT YTCNVDHKPSNTKVDKRVESKYGPPCPPCPAPEFLGGPSVFLFPP KPKDTLMISRTPEVTCVVVDVSQEDPEVQFNWYVDGVEVHNA KTKPREEQFNSTYRVVSVLTVLHQDWLNGKEYKCKVSNKGLPS SIEKTISKAKGQPREPQVYTLPPSQEEMTKNQVSLTCLVKGFYPS DIAVEWESNGQPENNYKTTPPVLDSDGSFFLYSRLTVDKSRWQE GNVFSCSVMHEALHNHYTQKSLSLSLGK |
| 37 | ABP5 | Heavy Chain Full, heavy variable 1 + IgG1 CH1 + GGGGS (SEQ ID NO: 5) + heavy variable 1 + IgG4 S228P (with or without C terminal Lys) | QVQLQESGPGLVKPSETLSLTCAVSGYSISSGAGWGWIRQPPGK GLEWIGLIVHSGSTYYNPSLKSRVTISVDTSKNQFSLKLSSVTAA DTAVYYCVLESVRGYGDYGGHHAFDIWGQGTMVTVSSASTKG PSVFPLAPSSKSTSGGTAALGCLVKDYFPEPVTVSWNSGALTSG VHTFPAVLQSSGLYSLSSVVTVPSSSLGTQTYICNVNHKPSNTKV DKRVEPKSCGGGGSQVQLQESGPGLVKPSETLSLTCAVSGYSISS GAGWGWIRQPPGKGLEWIGLIVHSGSTYYNPSLKSRVTISVDTS KNQFSLKLSSVTAADTAVYYCVLESVRGYGDYGGHHAFDIWG QGTMVTVSSASTKGPSVFPLAPCSRSTSESTAALGCLVKDYFPEP VTVSWNSGALTSGVHTFPAVLQSSGLYSLSSVVTVPSSSLGTKT YTCNVDHKPSNTKVDKRVESKYGPPCPPCPAPEFLGGPSVFLFPP KPKDTLMISRTPEVTCVVVDVSQEDPEVQFNWYVDGVEVHNA KTKPREEQFNSTYRVVSVLTVLHQDWLNGKEYKCKVSNKGLPS SIEKTISKAKGQPREPQVYTLPPSQEEMTKNQVSLTCLVKGFYPS DIAVEWESNGQPENNYKTTPPVLDSDGSFFLYSRLTVDKSRWQE GNVFSCSVMHEALHNHYTQKSLSLSLGK |
| 38 | ABP6 | Heavy Chain Full, heavy | QVQLQESGPGLVKPSETLSLTCAVSGYSISSGAGWGWIRQPPGK GLEWIGLIVHSGSTYYNPSLKSRVTISVDTSKNQFSLKLSSVTAA |

APPENDIX A-continued

SEQUENCES

| SEQ ID NO | Molecule | Description | SEQUENCE |
|---|---|---|---|
|  |  | variable 1 + IgG1 CH1 + GGGGS (SEQ ID NO: 5) + heavy variable 1 + IgG4 S228P (with or without C terminal Lys) | DTAVYYCVLESVRGYGDYGGHHAFDIWGQGTMVTVSSASTKG PSVFPLAPSSKSTSGGTAALGCLVKDYFPEPVTVSWNSGALTSG VHTFPAVLQSSGLYSLSSVVTVPSSSLGTQTYICNVNHKPSNTKV DKRVEPKSCGGGGSQVQLQESGPGLVKPSETLSLTCAVSGYSISS GAGWGWIRQPPGKGLEWIGLIVHSGSTYYNPSLKSRVTISVDTS KNQFSLKLSSVTAADTAVYYCVLESVRGYGDYGGHHAFDIWG QGTMVTVSSASTKGPSVFPLAPCSRSTSESTAALGCLVKDYFPEP VTVSWNSGALTSGVHTFPAVLQSSGLYSLSSVVTVPSSSLGTKT YTCNVDHKPSNTKVDKRVESKYGPPCPPCPAPEFLGGPSVFLFPP KPKDTLMISRTPEVTCVVVDVSQEDPEVQFNWYVDGVEVHNA KTKPREEQFNSTYRVVSVLTVLHQDWLNGKEYKCKVSNKGLPS SIEKTISKAKGQPREPQVYTLPPSQEEMTKNQVSLTCLVKGFYPS DIAVEWESNGQPENNYKTTPPVLDSDGSFFLYSRLTVDKSRWQE GNVFSCSVMHEALHNHYTQKSLSLSLGK |
| 42 | ABP7 | Heavy Chain Full, heavy variable 1 + IgG1 CH1 + GGGGS (SEQ ID NO: 5) + heavy variable 1 + IgG4 S228P (with or without C terminal Lys) | QVQLQESGPGLVKPSETLSLTCAVSGYSISSEYMWGWIRQPPGK GLEWIGLIYHSGKTYYNPSLKSRVTISVDTSKNQFSLKLSSVTAA DTAVYYCAREADRGYGDYGGHHAFDIWGQGTMVTVSSASTKG PSVFPLAPSSKSTSGGTAALGCLVKDYFPEPVTVSWNSGALTSG VHTFPAVLQSSGLYSLSSVVTVPSSSLGTQTYICNVNHKPSNTKV DKRVEPKSCGGGGSQVQLQESGPGLVKPSETLSLTCAVSGYSISS EYMWGWIRQPPGKGLEWIGLIYHSGKTYYNPSLKSRVTISVDTS KNQFSLKLSSVTAADTAVYYCAREADRGYGDYGGHHAFDIWG QGTMVTVSSASTKGPSVFPLAPCSRSTSESTAALGCLVKDYFPEP VTVSWNSGALTSGVHTFPAVLQSSGLYSLSSVVTVPSSSLGTKT YTCNVDHKPSNTKVDKRVESKYGPPCPPCPAPEFLGGPSVFLFPP KPKDTLMISRTPEVTCVVVDVSQEDPEVQFNWYVDGVEVHNA KTKPREEQFNSTYRVVSVLTVLHQDWLNGKEYKCKVSNKGLPS SIEKTISKAKGQPREPQVYTLPPSQEEMTKNQVSLTCLVKGFYPS DIAVEWESNGQPENNYKTTPPVLDSDGSFFLYSRLTVDKSRWQE GNVFSCSVMHEALHNHYTQKSLSLSLGK |
| 51 | ABP8 | Heavy Chain Full, heavy variable 1 + IgG1 CH1 + GGGGS (SEQ ID NO: 5) + heavy variable 1 + IgG4 S228P (with or without C terminal Lys) | QVQLQESGPGLVKPSETLSLTCAVSGYSISSEYMWGWIRQPPGK GLEWIGLIYHSGKTYYNPSLKSRVTISVDTSKNQFSLKLSSVTAA DTAVYYCAREADRGYGDYGGHHAFDIWGQGTMVTVSSASTKG PSVFPLAPSSKSTSGGTAALGCLVKDYFPEPVTVSWNSGALTSG VHTFPAVLQSSGLYSLSSVVTVPSSSLGTQTYICNVNHKPSNTKV DKRVEPKSCGGGGSQVQLQESGPGLVKPSETLSLTCAVSGYSISS EYMWGWIRQPPGKGLEWIGLIYHSGKTYYNPSLKSRVTISVDTS KNQFSLKLSSVTAADTAVYYCAREADRGYGDYGGHHAFDIWG QGTMVTVSSASTKGPSVFPLAPCSRSTSESTAALGCLVKDYFPEP VTVSWNSGALTSGVHTFPAVLQSSGLYSLSSVVTVPSSSLGTKT YTCNVDHKPSNTKVDKRVESKYGPPCPPCPAPEFLGGPSVFLFPP KPKDTLMISRTPEVTCVVVDVSQEDPEVQFNWYVDGVEVHNA KTKPREEQFNSTYRVVSVLTVLHQDWLNGKEYKCKVSNKGLPS SIEKTISKAKGQPREPQVYTLPPSQEEMTKNQVSLTCLVKGFYPS DIAVEWESNGQPENNYKTTPPVLDSDGSFFLYSRLTVDKSRWQE GNVFSCSVMHEALHNHYTQKSLSLSLGK |
| 57 | ABP9 | Heavy Chain Full, heavy variable 1 + IgG1 CH1 + GGGGS (SEQ ID NO: 5) + heavy variable 1 + IgG4 S228P (with or without C terminal Lys) | QLQLQESGPGLVKPSETLSLTCTVSGGSISSSSYAWGWIRQPPGK GLEWIGSIYYSGSTYYNPSLKSRVTISVDTSKNQFSLKLSSVTAA DTAVYYCARDSGRGYGDYGGHHAFDIWGQGTMVTVSSASTKG PSVFPLAPSSKSTSGGTAALGCLVKDYFPEPVTVSWNSGALTSG VHTFPAVLQSSGLYSLSSVVTVPSSSLGTQTYICNVNHKPSNTKV DKRVEPKSCGGGGSQLQLQESGPGLVKPSETLSLTCTVSGGSISS SSYAWGWIRQPPGKGLEWIGSIYYSGSTYYNPSLKSRVTISVDTS KNQFSLKLSSVTAADTAVYYCARDSGRGYGDYGGHHAFDIWG QGTMVTVSSASTKGPSVFPLAPCSRSTSESTAALGCLVKDYFPEP VTVSWNSGALTSGVHTFPAVLQSSGLYSLSSVVTVPSSSLGTKT YTCNVDHKPSNTKVDKRVESKYGPPCPPCPAPEFLGGPSVFLFPP KPKDTLMISRTPEVTCVVVDVSQEDPEVQFNWYVDGVEVHNA KTKPREEQFNSTYRVVSVLTVLHQDWLNGKEYKCKVSNKGLPS SIEKTISKAKGQPREPQVYTLPPSQEEMTKNQVSLTCLVKGFYPS DIAVEWESNGQPENNYKTTPPVLDSDGSFFLYSRLTVDKSRWQE GNVFSCSVMHEALHNHYTQKSLSLSLGK |
| 220 | ABP10 | Heavy Chain Full, heavy variable 1 + IgG1 CH1 + GGGGS (SEQ ID NO: 5) + heavy variable 1 + IgG4 | QLQLQESGPGLVKPSETLSLTCTVSGGSISSSSYAWGWIRQPPGK GLEWIGSIYYSGSTYYNPSLKSRVTISVDTSKNQFSLKLSSVTAA DTAVYYCARDSGRGYGDYGGHHAFDIWGQGTMVTVSSASTKG PSVFPLAPCSRSTSESTAALGCLVKDYFPEPVTVSWNSGALTSGV HTFPAVLQSSGLYSLSSVVTVPSSSLGTKTYTCNVDHKPSNTKV DKRVESKYGPPCPPCPAPEFLGGPSVFLFPPKPKDTLMISRTPEVT CVVVDVSQEDPEVQFNWYVDGVEVHNAKTKPREEQFNSTYRV VSVLTVLHQDWLNGKEYKCKVSNKGLPSSIEKTISKAKGQPREP |

APPENDIX A-continued

SEQUENCES

| SEQ ID NO | Molecule | Description | SEQUENCE |
|---|---|---|---|
| | | S228P (with or without C terminal Lys) | QVYTLPPSQEEMTKNQVSLTCLVKGFYPSDIAVEWESNGQPEN NYKTTPPVLDSDGSFFLYSRLTVDKSRWQEGNVFSCSVMHEAL HNHYTQKSLSLSLGKGGGGSQLQLQESGPGLVKPSETLSLTCTV SGGSISSSSYAWGWIRQPPGKGLEWIGSIYYSGSTYYNPSLKSRV TISVDTSKNQFSLKLSSVTAADTAVYYCARDSGRGYGDYGGHH AFDIWGQGTMVTVSSASTKGPSVFPLAPSSKSTSGGTAALGCLV KDYFPEPVTVSWNSGALTSGVHTFPAVLQSSGLYSLSSVVTVPS SSLGTQTYICNVNHKPSNTKVDKRVEPKSC |
| 171 | ABP11 | Heavy Chain Full (IgG1) | QVQLVQSGAEVKRPGSSVKVSCKASGGTFSSYYISWVRQVPGQ GLEWMGGIIPVPGTANYAQKFQGRVTITADESTAYMELSSLR SEDTAVYYCARAGGGYARGDHYYGMDVVVGQGTTVTVSSAST KGPSVFPLAPSSKSTSGGTAALGCLVKDYFPEPVTVSWNSGALT SGVHTFPAVLQSSGLYSLSSVVTVPSSSLGTQTYICNVNHKPSNT KVDKKVEPKSCDKTHTCPPCPAPELLGGPSVFLFPPKPKDTLMIS RTPEVTCVVVDVSHEDPEVKFNWYVDGVEVHNAKTKPREEQY ASTYRVVSVLTVLHQDWLNGKEYKCKVSNKALPAPIEKTISKA KGQPREPQVYTLPPSRDELTKNQVSLTCLVKGFYPSDIAVEWES NGQPENNYKTTPPVLDSDGSFFLYSKLTVDKSRWQQGNVFSCS VMHEALHNHYTQKSLSLSPGK |
| 172 | ABP12 | Heavy Chain Full (IgG1) | QVQLVQSGAEVKKPGSSVKVSCKASGGTFSSYYISWVRQAPGQ RLEWMGGIIPVPGTANYAQKFQGRVTITADESTAYMELSSLR SEDTAVYYCARAGGGYARGDHYYGMDVVVGQGTTVTVSSAST KGPSVFPLAPSSKSTSGGTAALGCLVKDYFPEPVTVSWNSGALT SGVHTFPAVLQSSGLYSLSSVVTVPSSSLGTQTYICNVNHKPSNT KVDKKVEPKSCDKTHTCPPCPAPELLGGPSVFLFPPKPKDTLMIS RTPEVTCVVVDVSHEDPEVKFNWYVDGVEVHNAKTKPREEQY ASTYRVVSVLTVLHQDWLNGKEYKCKVSNKALPAPIEKTISKA SDIAVEWESKGQPREPQVYTLPPSRDELTKNQVSLTCLVKGFYP NGQPENNYKTTPPVLDSDGSFFLYSKLTVDKSRWQQGNVFSCS VMHEALHNHYTQKSLSLSPGK |
| 173 | ABP13 | Heavy Chain Full (IgG1) | QVQLVQSGAEVKKPGSSVKVSCKASGGTFSRGAISWVRQAPGQ GLEWMGGIIPIEGTAYYAQKFQGRVTITADESTGTAYMELSSLR SEDTAVYYCARQSDYGLPRGMDVVVGQGTTVTVSSASTKGPSV FPLAPSSKSTSGGTAALGCLVKDYFPEPVTVSWNSGALTSGVHT FPAVLQSSGLYSLSSVVTVPSSSLGTQTYICNVNHKPSNTKVDK KVEPKSCDKTHTCPPCPAPELLGGPSVFLFPPKPKDTLMISRTPE VTCVVVDVSHEDPEVKFNWYVDGVEVHNAKTKPREEQYASTY RVVSVLTVLHQDWLNGKEYKCKVSNKALPAPIEKTISKAKGQP REPQVYTLPPSRDELTKNQVSLTCLVKGFYPSDIAVEWESNGQP ENNYKTTPPVLDSDGSFFLYSKLTVDKSRWQQGNVFSCSVMHE ALHNHYTQKSLSLSPGK |
| 174 | ABP14 | Heavy Chain Full (IgG1) | QVQLVQSGAEVKKPGSSVKVSCKASGGTFSSYAISWVRQAPGQ GLEWMGGIIPISGFTNYAQKFQGRVTITADESTSTAYMELSSLRS EDTAVYYCAREGGHYYSGWPYWGQGTLVTVSSASTKGPSVFP LAPSSKSTSGGTAALGCLVKDYFPEPVTVSWNSGALTSGVHTFP AVLQSSGLYSLSSVVTVPSSSLGTQTYICNVNHKPSNTKVDKKV EPKSCDKTHTCPPCPAPELLGGPSVFLFPPKPKDTLMISRTPEVTC VVVDVSHEDPEVKFNWYVDGVEVHNAKTKPREEQYASTYRVV SVLTVLHQDWLNGKEYKCKVSNKALPAPIEKTISKAKGQPREPQ VYTLPPSRDELTKNQVSLTCLVKGFYPSDIAVEWESNGQPENNY KTTPPVLDSDGSFFLYSKLTVDKSRWQQGNVFSCSVMHEALHN HYTQKSLSLSPGK |
| 175 | ABP15 | Heavy Chain Full (IgG1) | QVQLVQSGAEVKKPGSSVKVSCKASGGTFSSYAISWVRQAPGQ RLEWMGGIIPISGFTNYAQKFQGRVTITADESTSTAYMELSSLRS EDTAVYYCAREGGHYYSGWPYWGQGTLVTVSSASTKGPSVFP LAPSSKSTSGGTAALGCLVKDYFPEPVTVSWNSGALTSGVHTFP AVLQSSGLYSLSSVVTVPSSSLGTQTYICNVNHKPSNTKVDKKV EPKSCDKTHTCPPCPAPELLGGPSVFLFPPKPKDTLMISRTPEVTC VVVDVSHEDPEVKFNWYVDGVEVHNAKTKPREEQYASTYRVV SVLTVLHQDWLNGKEYKCKVSNKALPAPIEKTISKAKGQPREPQ VYTLPPSRDELTKNQVSLTCLVKGFYPSDIAVEWESNGQPENNY KTTPPVLDSDGSFFLYSKLTVDKSRWQQGNVFSCSVMHEALHN HYTQKSLSLSPGK |
| 176 | ABP16 | Heavy Chain Full (IgG1) | QVQLVQSGAEVKKPGSSVKVSCKASGGTFSSYAISWVRQAPGQ GLEWMGGIIPISGFTNYAQKFQGKVTITADESTSTAYMELSSLRS EDTAVYYCAREGGHYYSGWPYWGQGTLVTVSSASTKGPSVFP LAPSSKSTSGGTAALGCLVKDYFPEPVTVSWNSGALTSGVHTFP AVLQSSGLYSLSSVVTVPSSSLGTQTYICNVNHKPSNTKVDKKV |

APPENDIX A-continued

SEQUENCES

| SEQ ID NO | Molecule | Description | SEQUENCE |
|---|---|---|---|
| | | | EPKSCDKTHTCPPCPAPELLGGPSVFLFPPKPKDTLMISRTPEVTC VVVDVSHEDPEVKFNWYVDGVEVHNAKTKPREEQYASTYRVV SVLTVLHQDWLNGKEYKCKVSNKALPAPIEKTISKAKGQPREPQ VYTLPPSRDELTKNQVSLTCLVKGFYPSDIAVEWESNGQPENNY KTTPPVLDSDGSFFLYSKLTVDKSRWQQGNVFSCSVMHEALHN HYTQKSLSLSPGK |
| 177 | ABP17 | Heavy Chain Full (IgG1) | QVQLVQSGAEVKKPGSSVKVSCKASGGTFVRYAISWVRQAPGQ GLEWMGGIIPIFGEAQYAQRFQGRVTITADESTSTAYMELSSLRS EDTAVYYCAREGYYYGALPYWGQGTLVTVSSASTKGPSVFPLA PSSKSTSGGTAALGCLVKDYFPEPVTVSWNSGALTSGVHTFPAV LQSSGLYSLSSVVTVPSSSLGTQTYICNVNHKPSNTKVDKKVEP KSCDKTHTCPPCPAPELLGGPSVFLFPPKPKDTLMISRTPEVTCV VVDVSHEDPEVKFNWYVDGVEVHNAKTKPREEQYASTYRVVS VLTVLHQDWLNGKEYKCKVSNKALPAPIEKTISKAKGQPREPQ VYTLPPSRDELTKNQVSLTCLVKGFYPSDIAVEWESNGQPENNY KTTPPVLDSDGSFFLYSKLTVDKSRWQQGNVFSCSVMHEALHN HYTQKSLSLSPGK |
| 178 | ABP18 | Heavy Chain Full (IgG1) | QVQLVQSGAEVKKPGSSVKVSCKASGGTFVRYAISWVRQAPGQ GLEWMGGIIPIFGEAQYAQKFRGRATITADESTSTAYMELSSLRS EDTAVYYCAREGYYYGALPYWGQGTLVTVSSASTKGPSVFPLA PSSKSTSGGTAALGCLVKDYFPEPVTVSWNSGALTSGVHTFPAV LQSSGLYSLSSVVTVPSSSLGTQTYICNVNHKPSNTKVDKKVEP KSCDKTHTCPPCPAPELLGGPSVFLFPPKPKDTLMISRTPEVTCV VVDVSHEDPEVKFNWYVDGVEVHNAKTKPREEQYASTYRVVS VLTVLHQDWLNGKEYKCKVSNKALPAPIEKTISKAKGQPREPQ VYTLPPSRDELTKNQVSLTCLVKGFYPSDIAVEWESNGQPENNY KTTPPVLDSDGSFFLYSKLTVDKSRWQQGNVFSCSVMHEALHN HYTQKSLSLSPGK |
| 106 | ABP19 | Heavy Chain Full, heavy variable 1 + IgG1 CH1 + GGGGS (SEQ ID NO: 5) + heavy variable 1 + IgG4 S228P (with or without C terminal Lys) | QVQLVQSGAEVKKPGSSVKVSCKASGGTFSSYYISWVRQAPGQ GLEWMGGIIPVPGTANYAQKFQGRVTITADESTSTAYMELSSLR SEDTAVYYCARAGGGYARGDHYYGMDVVVGQGTTVTVSSAST KGPSVFPLAPSSKSTSGGTAALGCLVKDYFPEPVTVSWNSGALT SGVHTFPAVLQSSGLYSLSSVVTVPSSSLGTQTYICNVNHKPSNT KVDKRVEPKSCGGGGSQVQLVQSGAEVKKPGSSVKVSCKASG GTFSSYYISWVRQAPGQGLEWMGGIIPVPGTANYAQKFQGRVTI TADESTSTAYMELSSLRSEDTAVYYCARAGGGYARGDHYYGM DVVVGQGTTVTVSSASTKGPSVFPLAPCSRSTSESTAALGCLVKD YFPEPVTVSWNSGALTSGVHTFPAVLQSSGLYSLSSVVTVPSSSL GTKTYTCNVDHKPSNTKVDKRVESKYGPPCPPCPAPEFLGGPSV FLFPPKPKDTLMISRTPEVTCVVVDVSQEDPEVQFNWYVDGVE VHNAKTKPREEQFNSTYRVVSVLTVLHQDWLNGKEYKCKVSN KGLPSSIEKTISKAKGQPREPQVYTLPPSQEEMTKNQVSLTCLVK GFYPSDIAVEWESNGQPENNYKTTPPVLDSDGSFFLYSRLTVDK SRWQEGNVFSCSVMHEALHNHYTQKSLSLSLG |
| 108 | ABP20 | Heavy Chain Full, heavy variable 1 + IgG1 CH1 + GGGGS (SEQ ID NO: 5) + heavy variable 1 + IgG4 S228P (with or without C terminal Lys) | QVQLVQSGAEVKKPGSSVKVSCKASGGTFSRGAISWVRQAPGQ GLEWMGGIIPIEGTAYYAQKFQGRVTITADESTSTAYMELSSLRS EDTAVYYCARQSDYGLPRGMDVWGQGTTVTVSSASTKGPSVF PLAPSSKSTSGGTAALGCLVKDYFPEPVTVSWNSGALTSGVHTF PAVLQSSGLYSLSSVVTVPSSSLGTQTYICNVNHKPSNTKVDKR VEPKSCGGGGSQVQLVQSGAEVKKPGSSVKVSCKASGGTFSRG AISWVRQAPGQGLEWMGGIIPIEGTAYYAQKFQGRVTITADEST STAYMELSSLRSEDTAVYYCARQSDYGLPRGMDVWGQGTTVT VSSASTKGPSVFPLAPCSRSTSESTAALGCLVKDYFPEPVTVSWN SGALTSGVHTFPAVLQSSGLYSLSSVVTVPSSSLGTKTYTCNVD HKPSNTKVDKRVESKYGPPCPPCPAPEFLGGPSVFLFPPKPKDTL MISRTPEVTCVVVDVSQEDPEVQFNWYVDGVEVHNAKTKPREE QFNSTYRVVSVLTVLHQDWLNGKEYKCKVSNKGLPSSIEKTISK AKGQPREPQVYTLPPSQEEMTKNQVSLTCLVKGFYPSDIAVEWE SNGQPENNYKTTPPVLDSDGSFFLYSRLTVDKSRWQEGNVFSCS VMHEALHNHYTQKSLSLSLG |
| 110 | ABP21 | Heavy Chain Full, heavy variable 1 + IgG1 CH1 + GGGGS (SEQ ID NO: 5) + heavy variable 1 + IgG4 S228P (with or | QVQLVQSGAEVKKPGSSVKVSCKASGGTFSSYAISWVRQAPGQ GLEWMGGIIPISGFANYAQKFQGRVTITADESTSTAYMELSSLRS EDTAVYYCAREGGHYYSGWPYWGQGTLVTVSSASTKGPSVFP LAPSSKSTSGGTAALGCLVKDYFPEPVTVSWNSGALTSGVHTFP AVLQSSGLYSLSSVVTVPSSSLGTQTYICNVNHKPSNTKVDKRV EPKSCGGGGSQVQLVQSGAEVKKPGSSVKVSCKASGGTFSSYAI SWVRQAPGQGLEWMGGIIPISGFANYAQKFQGRVTITADESTST AYMELSSLRSEDTAVYYCAREGGHYYSGWPYWGQGTLVTVSS ASTKGPSVFPLAPCSRSTSESTAALGCLVKDYFPEPVTVSWNSG |

APPENDIX A-continued

SEQUENCES

| SEQ ID NO | Molecule | Description | SEQUENCE |
|---|---|---|---|
| | | without C terminal Lys) | ALTSGVHTFPAVLQSSGLYSLSSVVTVPSSSLGTKTYTCNVDHK PSNTKVDKRVESKYGPPCPPCPAPEFLGGPSVFLFPPKPKDTLMI SRTPEVTCVVVDVSQEDPEVQFNWYVDGVEVHNAKTKPREEQF NSTYRVVSVLTVLHQDWLNGKEYKCKVSNKGLPSSIEKTISKAK GQPREPQVYTLPPSQEEMTKNQVSLTCLVKGFYPSDIAVEWESN GQPENNYKTTPPVLDSDGSFFLYSRLTVDKSRWQEGNVFSCSV MHEALHNHYTQKSLSLSLG |
| 112 | ABP22 | Heavy Chain Full, heavy variable 1 + IgG1 CH1 + GGGGS (SEQ ID NO: 5) + heavy variable 1 + IgG4 S228P (with or without C terminal Lys) | QVQLVQSGAEVKKPGSSVKVSCKASGGTFVRYAISWVRQAPGQ GLEWMGGIIPIFGEAQYAQKFQGRVTITADESTSTAYMELSSLRS EDTAVYYCAREGYYYGALPYWGQGTLVTVSSASTKGPSVFPLA PSSKSTSGGTAALGCLVKDYFPEPVTVSWNSGALTSGVHTFPAV LQSSGLYSLSSVVTVPSSSLGTQTYICNVNHKPSNTKVDKRVEP KSCGGGGSQVQLVQSGAEVKKPGSSVKVSCKASGGTFVRYAIS WVRQAPGQGLEWMGGIIPIFGEAQYAQKFQGRVTITADESTSTA YMELSSLRSEDTAVYYCAREGYYYGALPYWGQGTLVTVSSAST KGPSVFPPLAPCSRSTSESTAALGCLVKDYFPEPVTVSWNSGALTS GVHTFPAVLQSSGLYSLSSVVTVPSSSLGTKTYTCNVDHKPSNT KVDKRVESKYGPPCPPCPAPEFLGGPSVFLFPPKPKDTLMISRTP EVTCVVVDVSQEDPEVQFNWYVDGVEVHNAKTKPREEQFNST YRVVSVLTVLHQDWLNGKEYKCKVSNKGLPSSIEKTISKAKGQ PREPQVYTLPPSQEEMTKNQVSLTCLVKGFYPSDIAVEWESNGQ PENNYKTTPPVLDSDGSFFLYSRLTVDKSRWQEGNVFSCSVMH EALHNHYTQKSLSLSLG |
| 114 | ABP23 | Heavy Chain Full, heavy variable 1 + IgG1 CH1 GGGGS (SEQ ID NO: 5) +30 heavy variable 1 + IgG4 S228P (with or without C terminal Lys) | QVQLQESGPGLVKPSETLSLTCAVSGYSISSEYMWGWIRQPPGK GLEWIGLIYHSGKTYYNPSLKSRVTISVDTSKNQFSLKLSSVTAA DTAVYYCARDSGRGYGDYGGHHAFDIWGQGTMVTVSSASTKG PSVFPLAPSSKSTSGGTAALGCLVKDYFPEPVTVSWNSGALTSG VHTFPAVLQSSGLYSLSSVVTVPSSSLGTQTYICNVNHKPSNTKV DKRVEPKSCGGGGSQVQLQESGPGLVKPSETLSLTCAVSGYSISS EYMWGWIRQPPGKGLEWIGLIYHSGKTYYNPSLKSRVTISVDTS KNQFSLKLSSVTAADTAVYYCARDSGRGYGDYGGHHAFDIWG QGTMVTVSSASTKGPSVFPLAPCSRSTSESTAALGCLVKDYFPEP VTVSWNSGALTSGVHTFPAVLQSSGLYSLSSVVTVPSSSLGTKT YTCNVDHKPSNTKVDKRVESKYGPPCPPCPAPEFLGGPSVFLFPP KPKDTLMISRTPEVTCVVVDVSQEDPEVQFNWYVDGVEVHNA KTKPREEQFNSTYRVVSVLTVLHQDWLNGKEYKCKVSNKGLPS SIEKTISKAKGQPREPQVYTLPPSQEEMTKNQVSLTCLVKGFYPS DIAVEWESNGQPENNYKTTPPVLDSDGSFFLYSRLTVDKSRWQE GNVFSCSVMHEALHNHYTQKSLSLSLG |
| 115 | ABP24 | Heavy Chain Full, heavy variable 1 + IgG1 CH1 GGGGS (SEQ ID NO: 5) + heavy variable 1 + IgG4 S228P (with or without C terminal Lys) | QVQLQESGPGLVKPSQTLSLTCTVSGGSISSGGAVWSWIRQHPG KGLEWIGGIAYSGSTYYNPSLKSRVTISVDTSKNQFSLKLSSVTA ADTAVYYCARDSVRGYGDYGGHHAFDIWGQGTMVTVSSASTK GPSVFPLAPSSKSTSGGTAALGCLVKDYFPEPVTVSWNSGALTS GVHTFPAVLQSSGLYSLSSVVTVPSSSLGTQTYICNVNHKPSNTK VDKRVEPKSCGGGGSQVQLQESGPGLVKPSQTLSLTCTVSGGSI SSGGAVWSWIRQHPGKGLEWIGGIAYSGSTYYNPSLKSRVTISV DTSKNQFSLKLSSVTAADTAVYYCARDSVRGYGDYGGHHAFDI WGQGTMVTVSSASTKGPSVFPLAPCSRSTSESTAALGCLVKDYF PEPVTVSWNSGALTSGVHTFPAVLQSSGLYSLSSVVTVPSSSLGT KTYTCNVDHKPSNTKVDKRVESKYGPPCPPCPAPEFLGGPSVFL FPPKPKDTLMISRTPEVTCVVVDVSQEDPEVQFNWYVDGVEVH NAKTKPREEQFNSTYRVVSVLTVLHQDWLNGKEYKCKVSNKG LPSSIEKTISKAKGQPREPQVYTLPPSQEEMTKNQVSLTCLVKGF YPSDIAVEWESNGQPENNYKTTPPVLDSDGSFFLYSRLTVDKSR WQEGNVFSCSVMHEALHNHYTQKSLSLSLG |
| 116 | ABP25 | Heavy Chain Full, heavy variable 1 + IgG4 S228P (with or without C terminal Lys) + GGGGSGGG GSGGGGS (SEQ ID NO: 6) + heavy | QVQLVQSGAEVKKPGSSVKVSCKASGGTFSSYYISWVRQAPGQ GLEWMGGIIPVPGTANYAQKFQGRVTITADESTSTAYMELSSLR SEDTAVYYCARAGGGYARGDHYYGMDVWGQGTTVTVSSAST KGPSVFPPLAPCSRSTSESTAALGCLVKDYFPEPVTVSWNSGALTS GVHTFPAVLQSSGLYSLSSVVTVPSSSLGTKTYTCNVDHKPSNT KVDKRVESKYGPPCPPCPAPEFLGGPSVFLFPPKPKDTLMISRTP EVTCVVVDVSQEDPEVQFNWYVDGVEVHNAKTKPREEQFNST YRVVSVLTVLHQDWLNGKEYKCKVSNKGLPSSIEKTISKAKGQ PREPQVYTLPPSQEEMTKNQVSLTCLVKGFYPSDIAVEWESNGQ PENNYKTTPPVLDSDGSFFLYSRLTVDKSRWQEGNVFSCSVMH EALHNHYTQKSLSLSLGGGGGSGGGGSGGGGSQVQLVQSGAE VKKPGSSVKVSCKASGGTFSSYYISWVRQAPGQGLEWMGGIIPV |

APPENDIX A-continued

SEQUENCES

| SEQ ID NO | Molecule | Description | SEQUENCE |
|---|---|---|---|
| | | variable 1 + IgG1 CH1 | PGTANYAQKFQGRVTITADESTSTAYMELSSLRSEDTAVYYCAR AGGGYARGDHYYGMDVWGQGTTVTVSSASTKGPSVFPLAPSS KSTSGGTAALGCLVKDYFPEPVTVSWNSGALTSGVHTFPAVLQ SSGLYSLSSVVTVPSSSLGTQTYICNVNHKPSNTKVDKRVEPKSC |
| 117 | ABP26 | Heavy Chain Full, heavy variable 1 + IgG4 S228P (with or without C terminal Lys) + GGGGSGGG GSGGGGS (SEQ ID NO: 6) + heavy variable 1 + IgG1 CH1 | QVQLVQSGAEVKKPGSSVKVSCKASGGTFSRGAISWVRQAPGQ GLEWMGGIIPIEGTAYYAQKFQGRVTITADESTSTAYMELSSLRS EDTAVYYCARQSDYGLPRGMDVWGQGTTVTVSSASTKGPSVF PLAPCSRSTSESTAALGCLVKDYFPEPVTVSWNSGALTSGVHTF PAVLQSSGLYSLSSVVTVPSSSLGTKTYTCNVDHKPSNTKVDKR VESKYGPPCPPCPAPEFLGGPSVFLFPPKPKDTLMISRTPEVTCVV VDVSQEDPEVQFNWYVDGVEVHNAKTKPREEQFNSTYRVVSV LTVLHQDWLNGKEYKCKVSNKGLPSSIEKTISKAKGQPREPQVY TLPPSQEEMTKNQVSLTCLVKGFYPSDIAVEWESNGQPENNYKT TPPVLDSDGSFFLYSRLTVDKSRWQEGNVFSCSVMHEALHNHY TQKSLSLSLGGGGSGGGGSGGGGSQVQLVQSGAEVKKPGSSV KVSCKASGGTFSRGAISWVRQAPGQGLEWMGGIIPIEGTAYYAQ KFQGRVTITADESTSTAYMELSSLRSEDTAVYYCARQSDYGLPR GMDVWGQGTTVTVSSASTKGPSVFPLAPSSKSTSGGTAALGCL VKDYFPEPVTVSWNSGALTSGVHTFPAVLQSSGLYSLSSVVTVP SSSLGTQTYICNVNHKPSNTKVDKRVEPKSC |
| 118 | ABP27 | Heavy Chain Full, heavy variable 1 + IgG4 S228P (with or without C terminal Lys) + GGGGSGGG GSGGGGS (SEQ ID NO: 6) + heavy variable 1 + IgG1 CH1 | QVQLVQSGAEVKKPGSSVKVSCKASGGTFSSYAISWVRQAPGQ GLEWMGGIIPISGFANYAQKFQGRVTITADESTSTAYMELSSLRS EDTAVYYCAREGGHYYSGWPYWGQGTLVTVSSASTKGPSVFP LAPCSRSTSESTAALGCLVKDYFPEPVTVSWNSGALTSGVHTFP AVLQSSGLYSLSSVVTVPSSSLGTKTYTCNVDHKPSNTKVDKRV ESKYGPPCPPCPAPEFLGGPSVFLFPPKPKDTLMISRTPEVTCVVV DVSQEDPEVQFNWYVDGVEVHNAKTKPREEQFNSTYRVVSVL TVLHQDWLNGKEYKCKVSNKGLPSSIEKTISKAKGQPREPQVYT LPPSQEEMTKNQVSLTCLVKGFYPSDIAVEWESNGQPENNYKTT PPVLDSDGSFFLYSRLTVDKSRWQEGNVFSCSVMHEALHNHYT QKSLSLSLGGGGSGGGGSGGGGSQVQLVQSGAEVKKPGSSVK VSCKASGGTFSSYAISWVRQAPGQGLEWMGGIIPISGFANYAQK FQGRVTITADESTSTAYMELSSLRSEDTAVYYCAREGGHYYSG WPYWGQGTLVTVSSASTKGPSVFPLAPSSKSTSGGTAALGCLV KDYFPEPVTVSWNSGALTSGVHTFPAVLQSSGLYSLSSVVTVPS SSLGTQTYICNVNHKPSNTKVDKRVEPKSC |
| 119 | ABP28 | Heavy Chain Full, heavy variable 1 + IgG4 S228P (with or without C terminal Lys) + GGGGSGGG GSGGGGS (SEQ ID NO: 6) + heavy variable 1 + IgG1 CH1 | QVQLVQSGAEVKKPGSSVKVSCKASGGTFVRYAISWVRQAPGQ GLEWMGGIIPIFGEAQYAQKFQGRVTITADESTSTAYMELSSLRS EDTAVYYCAREGYYYGALPYWGQGTLVTVSSASTKGPSVFPLA PCSRSTSESTAALGCLVKDYFPEPVTVSWNSGALTSGVHTFPAV LQSSGLYSLSSVVTVPSSSLGTKTYTCNVDHKPSNTKVDKRVES KYGPPCPPCPAPEFLGGPSVFLFPPKPKDTLMISRTPEVTCVVVD VSQEDPEVQFNWYVDGVEVHNAKTKPREEQFNSTYRVVSVLT VLHQDWLNGKEYKCKVSNKGLPSSIEKTISKAKGQPREPQVYTL PPSQEEMTKNQVSLTCLVKGFYPSDIAVEWESNGQPENNYKTTP PVLDSDGSFFLYSRLTVDKSRWQEGNVFSCSVMHEALHNHYTQ KSLSLSLGGGGSGGGGSGGGGSQVQLVQSGAEVKKPGSSVKV SCKASGGTFVRYAISWVRQAPGQGLEWMGGIIPIFGEAQYAQKF QGRVTITADESTSTAYMELSSLRSEDTAVYYCAREGYYYGALP YWGQGTLVTVSSASTKGPSVFPLAPSSKSTSGGTAALGCLVKDY FPEPVTVSWNSGALTSGVHTFPAVLQSSGLYSLSSVVTVPSSSLG TQTYICNVNHKPSNTKVDKRVEPKSC |
| 120 | ABP29 | Heavy Chain Full, heavy variable 1 + IgG4 S228P (with or without C terminal Lys) + GGGGSGGG GSGGGGS (SEQ ID NO: 6) + heavy variable 1 + IgG1 CH1 | QVQLQESGPGLVKPSETLSLTCAVSGYSISSEYMWGWIRQPPGK GLEWIGLIYHSGKTYYNPSLKSRVTISVDTSKNQFSLKLSSVTAA DTAVYYCARDSGRGYGDYGGHHAFDIWGQGTMVTVSSASTKG PSVFPLAPCSRSTSESTAALGCLVKDYFPEPVTVSWNSGALTSGV HTFPAVLQSSGLYSLSSVVTVPSSSLGTKTYTCNVDHKPSNTKV DKRVESKYGPPCPPCPAPEFLGGPSVFLFPPKPKDTLMISRTPEVT CVVVDVSQEDPEVQFNWYVDGVEVHNAKTKPREEQFNSTYRV VSVLTVLHQDWLNGKEYKCKVSNKGLPSSIEKTISKAKGQPREP QVYTLPPSQEEMTKNQVSLTCLVKGFYPSDIAVEWESNGQPEN NYKTTPPVLDSDGSFFLYSRLTVDKSRWQEGNVFSCSVMHEAL HNHYTQKSLSLSLGGGGSGGGGSGGGGSQVQLQESGPGLVKP SETLSLTCAVSGYSISSEYMWGWIRQPPGKGLEWIGLIYHSGKT YYNPSLKSRVTISVDTSKNQFSLKLSSVTAADTAVYYCARDSGR GYGDYGGHHAFDIWGQGTMVTVSSASTKGPSVFPLAPSSKSTS GGTAALGCLVKDYFPEPVTVSWNSGALTSGVHTFPAVLQSSGL YSLSSVVTVPSSSLGTQTYICNVNHKPSNTKVDKRVEPKSC |

APPENDIX A-continued

SEQUENCES

| SEQ ID NO | Molecule | Description | SEQUENCE |
|---|---|---|---|
| 121 | ABP30 | Heavy Chain Full, heavy variable 1 + IgG4 S228P (with or without C terminal Lys) + GGGGSGGG GSGGGGS (SEQ ID NO: 6) + heavy variable 1 + IgG1 CH1 | QVQLQESGPGLVKPSQTLSLTCTVSGGSISSGGAVWSWIRQHPG KGLEWIGGIAYSGSTYYNPSLKSRVTISVDTSKNQFSLKLSSVTA ADTAVYYCARDSVRGYGDYGGHHAFDIWGQGTMVTVSSASTK GPSVFPLAPCSRSTSESTAALGCLVKDYFPEPVTVSWNSGALTSG VHTFPAVLQSSGLYSLSSVVTVPSSSLGTKTYTCNVDHKPSNTK VDKRVESKYGPPCPPCPAPEFLGGPSVFLFPPKPKDTLMISRTPE VTCVVVDVSQEDPEVQFNWYVDGVEVHNAKTKPREEQFNSTY RVVSVLTVLHQDWLNGKEYKCKVSNKGLPSSIEKTISKAKGQP REPQVYTLPPSQEEMTKNQVSLTCLVKGFYPSDIAVEWESNGQP ENNYKTTPPVLDSDGSFFLYSRLTVDKSRWQEGNVFSCSVMHE ALHNHYTQKSLSLSLGGGGSGGGGSGGGGSQVQLQESGPGLV KPSQTLSLTCTVSGGSISSGGAVWSWIRQHPGKGLEWIGGIAYS GSTYYNPSLKSRVTISVDTSKNQFSLKLSSVTAADTAVYYCARD SVRGYGDYGGHHAFDIWGQGTMVTVSSASTKGPSVFPLAPSSK STSGGTAALGCLVKDYFPEPVTVSWNSGALTSGVHTFPAVLQSS GLYSLSSVVTVPSSSLGTQTYICNVNHKPSNTKVDKRVEPKSC |
| 122 | ABP31 | Heavy Chain Full, heavy variable 1 + IgG4 S228P (with or without C terminal Lys) + GGGGS (SEQ ID NO: 5) + heavy variable 1 + IgG1 CH1 | QVQLQESGPGLVKPSETLSLTCAVSGYSISSEYMWGWIRQPPGK GLEWIGLIYHSGKTYYNPSLKSRVTISVDTSKNQFSLKLSSVTAA DTAVYYCARDSGRGYGDYGGHHAFDIWGQGTMVTVSSASTKG PSVFPLAPCSRSTSESTAALGCLVKDYFPEPVTVSWNSGALTSGV HTFPAVLQSSGLYSLSSVVTVPSSSLGTKTYTCNVDHKPSNTKV DKRVESKYGPPCPPCPAPEFLGGPSVFLFPPKPKDTLMISRTPEVT CVVVDVSQEDPEVQFNWYVDGVEVHNAKTKPREEQFNSTYRV VSVLTVLHQDWLNGKEYKCKVSNKGLPSSIEKTISKAKGQPREP QVYTLPPSQEEMTKNQVSLTCLVKGFYPSDIAVEWESNGQPEN NYKTTPPVLDSDGSFFLYSRLTVDKSRWQEGNVFSCSVMHEAL HNHYTQKSLSLSLGGGGSQVQLQESGPGLVKPSETLSLTCAVS GYSISSEYMWGWIRQPPGKGLEWIGLIYHSGKTYYNPSLKSRVT ISVDTSKNQFSLKLSSVTAADTAVYYCARDSGRGYGDYGGHHA FDIWGQGTMVTVSSASTKGPSVFPLAPSSKSTSGGTAALGCLVK DYFPEPVTVSWNSGALTSGVHTFPAVLQSSGLYSLSSVVTVPSSS LGTQTYICNVNHKPSNTKVDKRVEPKSC |
| 123 | ABP32 | Heavy Chain Full, heavy variable 1 + IgG4 S228P (with or without C terminal Lys) + GGGGS (SEQ ID NO: 5) + heavy variable 1 + IgG1 CH1 | QVQLQESGPGLVKPSQTLSLTCTVSGGSISSGGAVWSWIRQHPG KGLEWIGGIAYSGSTYYNPSLKSRVTISVDTSKNQFSLKLSSVTA ADTAVYYCARDSVRGYGDYGGHHAFDIWGQGTMVTVSSASTK GPSVFPLAPCSRSTSESTAALGCLVKDYFPEPVTVSWNSGALTSG VHTFPAVLQSSGLYSLSSVVTVPSSSLGTKTYTCNVDHKPSNTK VDKRVESKYGPPCPPCPAPEFLGGPSVFLFPPKPKDTLMISRTPE VTCVVVDVSQEDPEVQFNWYVDGVEVHNAKTKPREEQFNSTY RVVSVLTVLHQDWLNGKEYKCKVSNKGLPSSIEKTISKAKGQP REPQVYTLPPSQEEMTKNQVSLTCLVKGFYPSDIAVEWESNGQP ENNYKTTPPVLDSDGSFFLYSRLTVDKSRWQEGNVFSCSVMHE ALHNHYTQKSLSLSLGGGGSQVQLQESGPGLVKPSQTLSLTCT VSGGSISSGGAVWSWIRQHPGKGLEWIGGIAYSGSTYYNPSLKS RVTISVDTSKNQFSLKLSSVTAADTAVYYCARDSVRGYGDYGG HHAFDIWGQGTMVTVSSASTKGPSVFPLAPSSKSTSGGTAALGC LVKDYFPEPVTVSWNSGALTSGVHTFPAVLQSSGLYSLSSVVTV PSSSLGTQTYICNVNHKPSNTKVDKRVEPKSC |
| 124 | ABP33 | Heavy Chain Full, heavy variable 1 + IgG1 CH1 + GGGGS (SEQ ID NO: 5) + heavy variable 2 + IgG4 S228P (with or without C terminal Lys) | QVQLVQSGAEVKKPGASVKVSCKASGYTFTSYYMHWVRQAPG QGLEWMGIINPSGGSTTYAQKFQGRVTMTRDTSTSTVYMELSSL RSEDTAVYYCARGQYGYYGGRLDVWGQGTTVTVSSASTKGPS VFPLAPSSKSTSGGTAALGCLVKDYFPEPVTVSWNSGALTSGVH TFPAVLQSSGLYSLSSVVTVPSSSLGTQTYICNVNHKPSNTKVDK RVEPKSCGGGGSQVQLVESGGGVVQPGRSLRLSCAASGFTSSY GMHWVRQAPGKGLEWVAVISYDGSNKYYADSVKGRFTISRDN SKNTLYLQMNSLRAEDTAVYYCARDGLGYMAWGQGTTVTVSS ASTKGPSVFPLAPCSRSTSESTAALGCLVKDYFPEPVTVSWNSG ALTSGVHTFPAVLQSSGLYSLSSVVTVPSSSLGTKTYTCNVDHK PSNTKVDKRVESKYGPPCPPCPAPEFLGGPSVFLFPPKPKDTLMI SRTPEVTCVVVDVSQEDPEVQFNWYVDGVEVHNAKTKPREEQF NSTYRVVSVLTVLHQDWLNGKEYKCKVSNKGLPSSIEKTISKAK GQPREPQVYTLPPSQEEMTKNQVSLTCLVKGFYPSDIAVEWESN GQPENNYKTTPPVLDSDGSFFLYSRLTVDKSRWQEGNVFSCSV MHEALHNHYTQKSLSLSLGK |
| 136 | ABP34 | Heavy Chain Full, C terminal Fab, common light chain | QVQLVESGGGVVQPGRSLRLSCAASGFTSSYGMHWVRQAPG KGLEWVAVISYDGSNKYYADSVKGRFTISRDNSKNTLYLQMNS LRAEDTAVYYCARDGLGYMAWGQGTTVTVSSASTKGPSVFPL APCSRSTSESTAALGCLVKDYFPEPVTVSWNSGALTSGVHTFPA VLQSSGLYSLSSVVTVPSSSLGTKTYTCNVDHKPSNTKVDKRVE |

APPENDIX A-continued

SEQUENCES

| SEQ ID NO | Molecule | Description | SEQUENCE |
|---|---|---|---|
| | | bispecific: heavy variable 2 + IgG4 S228P (with or without C terminal Lys) + GGGGS (SEQ ID NO: 5) + heavy variable 1 + IgG1 CH1 | SKYGPPCPPCPAPEFLGGPSVFLFPPKPKDTLMISRTPEVTCVVV DVSQEDPEVQFNWYVDGVEVHNAKTKPREEQFNSTYRVVSVL TVLHQDWLNGKEYKCKVSNKGLPSSIEKTISKAKGQPREPQVYT LPPSQEEMTKNQVSLTCLVKGFYPSDIAVEWESNGQPENNYKTT PPVLDSDGSFFLYSRLTVDKSRWQEGNVFSCSVMHEALHNHYT QKSLSLSLGKGGGGSQVQLVQSGAEVKKPGASVKVSCKASGYT FTSYYMHWVRQAPGQGLEWMGIINPSGGSTTYAQKFQGRVTM TRDTSTSTVYMELSSLRSEDTAVYYCARGQYGYYGGRLDVWG QGTTVTVSSASTKGPSVFPLAPSSKSTSGGTAALGCLVKDYFPEP VTVSWNSGALTSGVHTFPAVLQSSGLYSLSSVVTVPSSSLGTQT YICNVNHKPSNTKVDKRVEPKSC |

N TERMINAL FAB TM = HEAVY VARIABLE 1 + IGG1 CH1 + GGGGS (SEQ ID NO: 5) + HEAVY VARIABLE 1 + IGG4 S228P (WITH OR WITHOUT C TERMINAL LYS)

| SEQ ID NO | Molecule | Description | SEQUENCE |
|---|---|---|---|
| 8 | ABP1 | Light Chain Full | DIQMTQSPSSLSASVGDRVTITCRASQSISSYLNWYQQKPGKAP KLLIYAASSLQSGVPSRFSGSGSGTDFTLTISSLQPEDFATYYCQQ EYATPPTFGGGTKVEIKRTVAAPSVFIFPPSDEQLKSGTASVVCL LNNFYPREAKVQWKVDNALQSGNSQESVTEQDSKDSTYSLSST LTLSKADYEKHKVYACEVTHQGLSSPVTKSFNRGEC |
| 18 | ABP2 | Light Chain Full | DIQMTQSPSSLSASVGDRVTITCRASQSISSYLNWYQQKPGKAP KLLIYAASSLQSGVPSRFSGSGSGTDFTLTISSLQPEDFATYYCQQ EYNTPPTFGGGTKVEIKRTVAAPSVFIFPPSDEQLKSGTASVVCL LNNFYPREAKVQWKVDNALQSGNSQESVTEQDSKDSTYSLSST LTLSKADYEKHKVYACEVTHQGLSSPVTKSFNRGEC |
| 25 | ABP3 | Light Chain Full | DIQMTQSPSSLSASVGDRVTITCRASQSISSYLNWYQQKPGKAP KLLIYAASSLKYGVPSRFSGSGSGTDFTLTISSLQPEDFATYYCQ QEYNTPPTFGGGTKVEIKRTVAAPSVFIFPPSDEQLKSGTASVVC LLNNFYPREAKVQWKVDNALQSGNSQESVTEQDSKDSTYSLSS TLTLSKADYEKHKVYACEVTHQGLSSPVTKSFNRGEC |
| 33 | ABP4 | Light Chain Full | DIQMTQSPSSLSASVGDRVTITCRASKSIDSYLNWYQQKPGKAP KLLIYAASSLQSGVPSRFSGSGSGTDFTLTISSLQPEDFATYYCQQ EYNTPPTFGGGTKVEIKRTVAAPSVFIFPPSDEQLKSGTASVVCL LNNFYPREAKVQWKVDNALQSGNSQESVTEQDSKDSTYSLSST LTLSKADYEKHKVYACEVTHQGLSSPVTKSFNRGEC |
| 33 | ABP5 | Light Chain Full | DIQMTQSPSSLSASVGDRVTITCRASKSIDSYLNWYQQKPGKAP KLLIYAASSLQSGVPSRFSGSGSGTDFTLTISSLQPEDFATYYCQQ EYNTPPTFGGGTKVEIKRTVAAPSVFIFPPSDEQLKSGTASVVCL LNNFYPREAKVQWKVDNALQSGNSQESVTEQDSKDSTYSLSST LTLSKADYEKHKVYACEVTHQGLSSPVTKSFNRGEC |
| 39 | ABP6 | Light Chain Full | DIQMTQSPSSLSASVGDRVTITCRASQSISSYLNWYQQKPGKAP KLLIYAADSLQSGVPSRFSGSGSGTDFTLTISSLQPEDFATYYCQ QEYNTPPTFGGGTKVEIKRTVAAPSVFIFPPSDEQLKSGTASVVC LLNNFYPREAKVQWKVDNALQSGNSQESVTEQDSKDSTYSLSS TLTLSKADYEKHKVYACEVTHQGLSSPVTKSFNRGEC |
| 43 | ABP7 | Light Chain Full | DIQMTQSPSSLSASVGDRVTITCRASQSINSYLNWYQQKPGKAP KLLIYAASSLDSGVPSRFSGSGSGTDFTLTISSLQPEDFATYYCQQ EYNTPPTFGGGTKVEIKRTVAAPSVFIFPPSDEQLKSGTASVVCL LNNFYPREAKVQWKVDNALQSGNSQESVTEQDSKDSTYSLSST LTLSKADYEKHKVYACEVTHQGLSSPVTKSFNRGEC |
| 52 | ABP8 | Light Chain Full | DIQMTQSPSSLSASVGDRVTITCGASQSISTYLNWYQQKPGKAP KLLIYSASSLESGVPSRFSGSGSGTDFTLTISSLQPEDFATYYCQQ EYNTPPSFGGGTKVEIKRTVAAPSVFIFPPSDEQLKSGTASVVCL LNNFYPREAKVQWKVDNALQSGNSQESVTEQDSKDSTYSLSST LTLSKADYEKHKVYACEVTHQGLSSPVTKSFNRGEC |
| 8 | ABP9 | Light Chain Full | DIQMTQSPSSLSASVGDRVTITCRASQSISSYLNWYQQKPGKAP KLLIYAASSLQSGVPSRFSGSGSGTDFTLTISSLQPEDFATYYCQQ EYATPPTFGGGTKVEIKRTVAAPSVFIFPPSDEQLKSGTASVVCL LNNFYPREAKVQWKVDNALQSGNSQESVTEQDSKDSTYSLSST LTLSKADYEKHKVYACEVTHQGLSSPVTKSFNRGEC |
| 8 | ABP10 | Light Chain Full | DIQMTQSPSSLSASVGDRVTITCRASQSISSYLNWYQQKPGKAP KLLIYAASSLQSGVPSRFSGSGSGTDFTLTISSLQPEDFATYYCQQ EYATPPTFGGGTKVEIKRTVAAPSVFIFPPSDEQLKSGTASVVCL LNNFYPREAKVQWKVDNALQSGNSQESVTEQDSKDSTYSLSST LTLSKADYEKHKVYACEVTHQGLSSPVTKSFNRGEC |

APPENDIX A-continued

SEQUENCES

| SEQ ID NO | Molecule | Description | SEQUENCE |
|---|---|---|---|
| 107 | ABP11 | Light Chain Full | DIVMTQSPLSLPVTPGEPASISCRSSQSLLHSNGYNYLDWYLQKP GQSPQLLIYLGSNRASGVPDRFSGSGSGTDFTLKISRVEAEDVGV YYCMQKIGTPLTFGGGTKVEIKRTVAAPSVFIFPPSDEQLKSGTA SVVCLLNNFYPREAKVQWKVDNALQSGNSQESVTEQDSKDSTY SLSSTLTLSKADYEKHKVYACEVTHQGLSSPVTKSFNRGEC |
| 107 | ABP12 | Light Chain Full | DIVMTQSPLSLPVTPGEPASISCRSSQSLLHSNGYNYLDWYLQKP GQSPQLLIYLGSNRASGVPDRFSGSGSGTDFTLKISRVEAEDVGV YYCMQKIGTPLTFGGGTKVEIKRTVAAPSVFIFPPSDEQLKSGTA SVVCLLNNFYPREAKVQWKVDNALQSGNSQESVTEQDSKDSTY SLSSTLTLSKADYEKHKVYACEVTHQGLSSPVTKSFNRGEC |
| 109 | ABP13 | Light Chain Full | DIQLTQSPSSVSASVGDRVTITCRASQGISSWLAWYQQKPGKAP KLLIYGASSLQSGVPSRFSGSGSGTDFTLTISSLQPEDFATYYCQQ ASLFPPTFGGGTKVEIKRTVAAPSVFIFPPSDEQLKSGTASVVCLL NNFYPREAKVQWKVDNALQSGNSQESVTEQDSKDSTYSLSSTL TLSKADYEKHKVYACEVTHQGLSSPVTKSFNRGEC |
| 111 | ABP14 | Light Chain Full | EIVLTQSPATLSLSPGERATLSCRASQSVSSYLAWYQQKPGQAP RLLIYDASNRATGIPARFSGSGSGTDFTLTISSLEPEDFAVYYCQQ RLVFPPTFGGGTKVEIKRTVAAPSVFIFPPSDEQLKSGTASVVCL LNNFYPREAKVQWKVDNALQSGNSQESVTEQDSKDSTYSLSST LTLSKADYEKHKVYACEVTHQGLSSPVTKSFNRGEC |
| 111 | ABP15 | Light Chain Full | EIVLTQSPATLSLSPGERATLSCRASQSVSSYLAWYQQKPGQAP RLLIYDASNRATGIPARFSGSGSGTDFTLTISSLEPEDFAVYYCQQ RLVFPPTFGGGTKVEIKRTVAAPSVFIFPPSDEQLKSGTASVVCL LNNFYPREAKVQWKVDNALQSGNSQESVTEQDSKDSTYSLSST LTLSKADYEKHKVYACEVTHQGLSSPVTKSFNRGEC |
| 111 | ABP16 | Light Chain Full | EIVLTQSPATLSLSPGERATLSCRASQSVSSYLAWYQQKPGQAP RLLIYDASNRATGIPARFSGSGSGTDFTLTISSLEPEDFAVYYCQQ RLVFPPTFGGGTKVEIKRTVAAPSVFIFPPSDEQLKSGTASVVCL LNNFYPREAKVQWKVDNALQSGNSQESVTEQDSKDSTYSLSST LTLSKADYEKHKVYACEVTHQGLSSPVTKSFNRGEC |
| 113 | ABP17 | Light Chain Full | EIVLTQSPATLSLSPGERATLSCRASQSVSSYLAWYQQKPGQAP RLLIYDASNRATGIPARFSGSGSGTDFTLTISSLEPEDFAVYYCQQ HSVFPPTFGGGTKVEIKRTVAAPSVFIFPPSDEQLKSGTASVVCL LNNFYPREAKVQWKVDNALQSGNSQESVTEQDSKDSTYSLSST LTLSKADYEKHKVYACEVTHQGLSSPVTKSFNRGEC |
| 113 | ABP18 | Light Chain Full | EIVLTQSPATLSLSPGERATLSCRASQSVSSYLAWYQQKPGQAP RLLIYDASNRATGIPARFSGSGSGTDFTLTISSLEPEDFAVYYCQQ HSVFPPTFGGGTKVEIKRTVAAPSVFIFPPSDEQLKSGTASVVCL LNNFYPREAKVQWKVDNALQSGNSQESVTEQDSKDSTYSLSST LTLSKADYEKHKVYACEVTHQGLSSPVTKSFNRGEC |
| 107 | ABP19 | Light Chain Full | DIVMTQSPLSLPVTPGEPASISCRSSQSLLHSNGYNYLDWYLQKP GQSPQLLIYLGSNRASGVPDRFSGSGSGTDFTLKISRVEAEDVGV YYCMQKIGTPLTFGGGTKVEIKRTVAAPSVFIFPPSDEQLKSGTA SVVCLLNNFYPREAKVQWKVDNALQSGNSQESVTEQDSKDSTY SLSSTLTLSKADYEKHKVYACEVTHQGLSSPVTKSFNRGEC |
| 109 | ABP20 | Light Chain Full | DIQLTQSPSSVSASVGDRVTITCRASQGISSWLAWYQQKPGKAP KLLIYGASSLQSGVPSRFSGSGSGTDFTLTISSLQPEDFATYYCQQ ASLFPPTFGGGTKVEIKRTVAAPSVFIFPPSDEQLKSGTASVVCLL NNFYPREAKVQWKVDNALQSGNSQESVTEQDSKDSTYSLSSTL TLSKADYEKHKVYACEVTHQGLSSPVTKSFNRGEC |
| 111 | ABP21 | Light Chain Full | EIVLTQSPATLSLSPGERATLSCRASQSVSSYLAWYQQKPGQAP RLLIYDASNRATGIPARFSGSGSGTDFTLTISSLEPEDFAVYYCQQ RLVFPPTFGGGTKVEIKRTVAAPSVFIFPPSDEQLKSGTASVVCL LNNFYPREAKVQWKVDNALQSGNSQESVTEQDSKDSTYSLSST LTLSKADYEKHKVYACEVTHQGLSSPVTKSFNRGEC |
| 113 | ABP22 | Light Chain Full | EIVLTQSPATLSLSPGERATLSCRASQSVSSYLAWYQQKPGQAP RLLIYDASNRATGIPARFSGSGSGTDFTLTISSLEPEDFAVYYCQQ HSVFPPTFGGGTKVEIKRTVAAPSVFIFPPSDEQLKSGTASVVCL LNNFYPREAKVQWKVDNALQSGNSQESVTEQDSKDSTYSLSST LTLSKADYEKHKVYACEVTHQGLSSPVTKSFNRGEC |

APPENDIX A-continued

SEQUENCES

| SEQ ID NO | Molecule | Description | SEQUENCE |
|---|---|---|---|
| 8 | ABP23 | Light Chain Full | DIQMTQSPSSLSASVGDRVTITCRASQSISSYLNWYQQKPGKAP KLLIYAASSLQSGVPSRFSGSGSGTDFTLTISSLQPEDFATYYCQQ EYATPPTFGGGTKVEIKRTVAAPSVFIFPPSDEQLKSGTASVVCL LNNFYPREAKVQWKVDNALQSGNSQESVTEQDSKDSTYSLSST LTLSKADYEKHKVYACEVTHQGLSSPVTKSFNRGEC |
| 8 | ABP24 | Light Chain Full | DIQMTQSPSSLSASVGDRVTITCRASQSISSYLNWYQQKPGKAP KLLIYAASSLQSGVPSRFSGSGSGTDFTLTISSLQPEDFATYYCQQ EYATPPTFGGGTKVEIKRTVAAPSVFIFPPSDEQLKSGTASVVCL LNNFYPREAKVQWKVDNALQSGNSQESVTEQDSKDSTYSLSST LTLSKADYEKHKVYACEVTHQGLSSPVTKSFNRGEC |
| 107 | ABP25 | Light Chain Full | DIVMTQSPLSLPVTPGEPASISCRSSQSLLHSNGYNYLDWYLQKP GQSPQLLIYLGSNRASGVPDRFSGSGSGTDFTLKISRVEAEDVGV YYCMQKIGTPLTFGGGTKVEIKRTVAAPSVFIFPPSDEQLKSGTA SVVCLLNNFYPREAKVQWKVDNALQSGNSQESVTEQDSKDSTY SLSSTLTLSKADYEKHKVYACEVTHQGLSSPVTKSFNRGEC |
| 109 | ABP26 | Light Chain Full | DIQLTQSPSSVSASVGDRVTITCRASQGISSWLAWYQQKPGKAP KLLIYGASSLQSGVPSRFSGSGSGTDFTLTISSLQPEDFATYYCQQ ASLFPPTFGGGTKVEIKRTVAAPSVFIFPPSDEQLKSGTASVVCLL NNFYPREAKVQWKVDNALQSGNSQESVTEQDSKDSTYSLSSTL TLSKADYEKHKVYACEVTHQGLSSPVTKSFNRGEC |
| 111 | ABP27 | Light Chain Full | EIVLTQSPATLSLSPGERATLSCRASQSVSSYLAWYQQKPGQAP RLLIYDASNRATGIPARFSGSGSGTDFTLTISSLEPEDFAVYYCQQ RLVFPPTFGGGTKVEIKRTVAAPSVFIFPPSDEQLKSGTASVVCL LNNFYPREAKVQWKVDNALQSGNSQESVTEQDSKDSTYSLSST LTLSKADYEKHKVYACEVTHQGLSSPVTKSFNRGEC |
| 113 | ABP28 | Light Chain Full | EIVLTQSPATLSLSPGERATLSCRASQSVSSYLAWYQQKPGQAP RLLIYDASNRATGIPARFSGSGSGTDFTLTISSLEPEDFAVYYCQQ HSVFPPTFGGGTKVEIKRTVAAPSVFIFPPSDEQLKSGTASVVCL LNNFYPREAKVQWKVDNALQSGNSQESVTEQDSKDSTYSLSST LTLSKADYEKHKVYACEVTHQGLSSPVTKSFNRGEC |
| 8 | ABP29 | Light Chain Full | DIQMTQSPSSLSASVGDRVTITCRASQSISSYLNWYQQKPGKAP KLLIYAASSLQSGVPSRFSGSGSGTDFTLTISSLQPEDFATYYCQQ EYATPPTFGGGTKVEIKRTVAAPSVFIFPPSDEQLKSGTASVVCL LNNFYPREAKVQWKVDNALQSGNSQESVTEQDSKDSTYSLSST LTLSKADYEKHKVYACEVTHQGLSSPVTKSFNRGEC |
| 8 | ABP30 | Light Chain Full | DIQMTQSPSSLSASVGDRVTITCRASQSISSYLNWYQQKPGKAP KLLIYAASSLQSGVPSRFSGSGSGTDFTLTISSLQPEDFATYYCQQ EYATPPTFGGGTKVEIKRTVAAPSVFIFPPSDEQLKSGTASVVCL LNNFYPREAKVQWKVDNALQSGNSQESVTEQDSKDSTYSLSST LTLSKADYEKHKVYACEVTHQGLSSPVTKSFNRGEC |
| 8 | ABP31 | Light Chain Full | DIQMTQSPSSLSASVGDRVTITCRASQSISSYLNWYQQKPGKAP KLLIYAASSLQSGVPSRFSGSGSGTDFTLTISSLQPEDFATYYCQQ EYATPPTFGGGTKVEIKRTVAAPSVFIFPPSDEQLKSGTASVVCL LNNFYPREAKVQWKVDNALQSGNSQESVTEQDSKDSTYSLSST LTLSKADYEKHKVYACEVTHQGLSSPVTKSFNRGEC |
| 8 | ABP32 | Light Chain Full | DIQMTQSPSSLSASVGDRVTITCRASQSISSYLNWYQQKPGKAP KLLIYAASSLQSGVPSRFSGSGSGTDFTLTISSLQPEDFATYYCQQ EYATPPTFGGGTKVEIKRTVAAPSVFIFPPSDEQLKSGTASVVCL LNNFYPREAKVQWKVDNALQSGNSQESVTEQDSKDSTYSLSST LTLSKADYEKHKVYACEVTHQGLSSPVTKSFNRGEC |
| 125 | ABP33 | Light Chain Full | DIVMTQSPLSLPVTPGEPASISCRSSQSLLHSNGYNYLDWYLQKP GQSPQLLIYLGSNRASGVPDRFSGSGSGTDFTLKISRVEAEDVGV YYCMQALQTPITFGGGTKVEIKRTVAAPSVFIFPPSDEQLKSGTA SVVCLLNNFYPREAKVQWKVDNALQSGNSQESVTEQDSKDSTY SLSSTLTLSKADYEKHKVYACEVTHQGLSSPVTKSFNRGEC |
| 125 | ABP34 | Light Chain Full | DIVMTQSPLSLPVTPGEPASISCRSSQSLLHSNGYNYLDWYLQKP GQSPQLLIYLGSNRASGVPDRFSGSGSGTDFTLKISRVEAEDVGV YYCMQALQTPITFGGGTKVEIKRTVAAPSVFIFPPSDEQLKSGTA SVVCLLNNFYPREAKVQWKVDNALQSGNSQESVTEQDSKDSTY SLSSTLTLSKADYEKHKVYACEVTHQGLSSPVTKSFNRGEC |

APPENDIX A-continued

SEQUENCES

| SEQ ID NO | Molecule | Description | SEQUENCE |
|---|---|---|---|
| 9 | ABP1 | $V_H$ | QVQLQESGPGLVKPSETLSLTCAVSGYSISSGLGWWIRQPPGK<br>GLEWIGGIYESGSTYYNPSLKSRVTISVDTSKNQFSLKLSSVTAA<br>DTAVYYCAHERVRGYGDYGGHHAFDIWGQGTMVTVSS |
| 19 | ABP2 | $V_H$ | QVQLQESGPGLVKPSQTLSLTCTVSGGSISSGGAVVVSWIRQHPG<br>KGLEWIGGIAYSGSTYYNPSLKSRVTISVDTSKNQFSLKLSSVTA<br>ADTAVYYCADENVRGYGDYGGHHAFDIWGQGTMVTVSS |
| 26 | ABP3 | $V_H$ | QVQLQESGPGLVKPSETLSLTCAVSGYSISSGAGWGWIRQPPGK<br>GLEWIGLIVHSGSTYYNPSLKSRVTISVDTSKNQFSLKLSSVTAA<br>DTAVYYCVLESVRGYGDYGGHHAFDIWGQGTMVTVSS |
| 34 | ABP4 | $V_H$ | QVQLQESGPGLVKPSETLSLTCAVSGYSISSGAGWGWIRQPPGK<br>GPEWIGLIVHSGSTYYNPSLKSRVTISVDTSKNQFSLKLSSVTAA<br>DTAVYYCVLESVRGYGDYGGHHAFDIWGQGTMVTVSS |
| 26 | ABP5 | $V_H$ | QVQLQESGPGLVKPSETLSLTCAVSGYSISSGAGWGWIRQPPGK<br>GLEWIGLIVHSGSTYYNPSLKSRVTISVDTSKNQFSLKLSSVTAA<br>DTAVYYCVLESVRGYGDYGGHHAFDIWGQGTMVTVSS |
| 26 | ABP6 | $V_H$ | QVQLQESGPGLVKPSETLSLTCAVSGYSISSGAGWGWIRQPPGK<br>GLEWIGLIVHSGSTYYNPSLKSRVTISVDTSKNQFSLKLSSVTAA<br>DTAVYYCVLESVRGYGDYGGHHAFDIWGQGTMVTVSS |
| 44 | ABP7 | $V_H$ | QVQLQESGPGLVKPSETLSLTCAVSGYSISSEYMWGWIRQPPGK<br>GLEWIGLIYHSGKTYYNPSLKSRVTISVDTSKNQFSLKLSSVTAA<br>DTAVYYCAREADRGYGDYGGHHAFDIWGQGTMVTVSS |
| 44 | ABP8 | $V_H$ | QVQLQESGPGLVKPSETLSLTCAVSGYSISSEYMWGWIRQPPGK<br>GLEWIGLIYHSGKTYYNPSLKSRVTISVDTSKNQFSLKLSSVTAA<br>DTAVYYCAREADRGYGDYGGHHAFDIWGQGTMVTVSS |
| 58 | ABP9 | $V_H$ | QLQLQESGPGLVKPSETLSLTCTVSGGSISSSSYAWGWIRQPPGK<br>GLEWIGSIYYSGSTYYNPSLKSRVTISVDTSKNQFSLKLSSVTAA<br>DTAVYYCARDSGRGYGDYGGHHAFDIWGQGTMVTVSS |
| 58 | ABP10 | $V_H$ | QLQLQESGPGLVKPSETLSLTCTVSGGSISSSSYAWGWIRQPPGK<br>GLEWIGSIYYSGSTYYNPSLKSRVTISVDTSKNQFSLKLSSVTAA<br>DTAVYYCARDSGRGYGDYGGHHAFDIWGQGTMVTVSS |
| 62 | ABP11 | $V_H$ | QVQLVQSGAEVKRPGSSVKVSCKASGGTFSSYYISWVRQVPGQ<br>GLEWMGGIIPVPGTANYAQKFQGRVTITADESTSTAYMELSSLR<br>SEDTAVYYCARAGGGYARGDHYYGMDVVVGQGTTVTVSS |
| 70 | ABP12 | $V_H$ | QVQLVQSGAEVKKPGSSVKVSCKASGGTFSSYYISWVRQAPGQ<br>RLEWMGGIIPVPGTANYAQKFQGRVTITADESTSTAYMELSSLR<br>SEDTAVYYCARAGGGYARGDHYYGMDVVVGQGTTVTVSS |
| 71 | ABP13 | $V_H$ | QVQLVQSGAEVKKPGSSVKVSCKASGGTFSRGAISWVRQAPGQ<br>GLEWMGGIIPIEGTAYYAQKFQGRVTITADESTGTAYMELSSLR<br>SEDTAVYYCARQSDYGLPRGMDVVVGQGTTVTVSS |
| 79 | ABP14 | $V_H$ | QVQLVQSGAEVKKPGSSVKVSCKASGGTFSSYAISWVRQAPGQ<br>GLEWMGGIIPISGFTNYAQKFQGRVTITADESTSTAYMELSSLRS<br>EDTAVYYCAREGGHYYSGWPYWGQGTLVTVSS |
| 87 | ABP15 | $V_H$ | QVQLVQSGAEVKKPGSSVKVSCKASGGTFSSYAISWVRQAPGQ<br>RLEWMGGIIPISGFTNYAQKFQGRVTITADESTSTAYMELSSLRS<br>EDTAVYYCAREGGHYYSGWPYWGQGTLVTVSS |
| 88 | ABP16 | $V_H$ | QVQLVQSGAEVKKPGSSVKVSCKASGGTFSSYAISWVRQAPGQ<br>GLEWMGGIIPISGFTNYAQKFQGKVTITADESTSTAYMELSSLRS<br>EDTAVYYCAREGGHYYSGWPYWGQGTLVTVSS |
| 89 | ABP17 | $V_H$ | QVQLVQSGAEVKKPGSSVKVSCKASGGTFVRYAISWVRQAPGQ<br>GLEWMGGIIPIFGEAQYAQRFQGRVTITADESTSTAYMELSSLRS<br>EDTAVYYCAREGYYYGALPYWGQGTLVTVSS |
| 95 | ABP18 | $V_H$ | QVQLVQSGAEVKKPGSSVKVSCKASGGTFVRYAISWVRQAPGQ<br>GLEWMGGIIPIFGEAQYAQKFRGRATITADESTSTAYMELSSLRS<br>EDTAVYYCAREGYYYGALPYWGQGTLVTVSS |

APPENDIX A-continued

SEQUENCES

| SEQ ID NO | Molecule | Description | SEQUENCE |
|---|---|---|---|
| 97 | ABP19 | V_H | QVQLVQSGAEVKKPGSSVKVSCKASGGTFSSYYISWVRQAPGQ GLEWMGGIIPVPGTANYAQKFQGRVTITADESTSTAYMELSSLR SEDTAVYYCARAGGGYARGDHYYGMDVVVGQGTTVTVSS |
| 98 | ABP20 | V_H | QVQLVQSGAEVKKPGSSVKVSCKASGGTFSRGAISWVRQAPGQ GLEWMGGIIPIEGTAYYAQKFQGRVTITADESTSTAYMELSSLRS EDTAVYYCARQSDYGLPRGMDVVVGQGTTVTVSS |
| 99 | ABP21 | V_H | QVQLVQSGAEVKKPGSSVKVSCKASGGTFSSYAISWVRQAPGQ GLEWMGGIIPISGFANYAQKFQGRVTITADESTSTAYMELSSLRS EDTAVYYCAREGGHYYSGWPYWGQGTLVTVSS |
| 101 | ABP22 | V_H | QVQLVQSGAEVKKPGSSVKVSCKASGGTFVRYAISWVRQAPGQ GLEWMGGIIPIFGEAQYAQKFQGRVTITADESTSTAYMELSSLRS EDTAVYYCAREGYYYGALPYWGQGTLVTVSS |
| 104 | ABP23 | V_H | QVQLQESGPGLVKPSETLSLTCAVSGYSISSEYMWGWIRQPPGK GLEWIGLIYHSGKTYYNPSLKSRVTISVDTSKNQFSLKLSSVTAA DTAVYYCARDSGRGYGDYGGHHAFDIWGQGTMVTVSS |
| 105 | ABP24 | V_H | QVQLQESGPGLVKPSQTLSLTCTVSGGSISSGGAVVVSWIRQHPG KGLEWIGGIAYSGSTYYNPSLKSRVTISVDTSKNQFSLKLSSVTA ADTAVYYCARDSVRGYGDYGGHHAFDIWGQGTMVTVSS |
| 97 | ABP25 | V_H | QVQLVQSGAEVKKPGSSVKVSCKASGGTFSSYYISWVRQAPGQ GLEWMGGIIPVPGTANYAQKFQGRVTITADESTSTAYMELSSLR SEDTAVYYCARAGGGYARGDHYYGMDVVVGQGTTVTVSS |
| 98 | ABP26 | V_H | QVQLVQSGAEVKKPGSSVKVSCKASGGTFSRGAISWVRQAPGQ GLEWMGGIIPIEGTAYYAQKFQGRVTITADESTSTAYMELSSLRS EDTAVYYCARQSDYGLPRGMDVVVGQGTTVTVSS |
| 99 | ABP27 | V_H | QVQLVQSGAEVKKPGSSVKVSCKASGGTFSSYAISWVRQAPGQ GLEWMGGIIPISGFANYAQKFQGRVTITADESTSTAYMELSSLRS EDTAVYYCAREGGHYYSGWPYWGQGTLVTVSS |
| 101 | ABP28 | V_H | QVQLVQSGAEVKKPGSSVKVSCKASGGTFVRYAISWVRQAPGQ GLEWMGGIIPIFGEAQYAQKFQGRVTITADESTSTAYMELSSLRS EDTAVYYCAREGYYYGALPYWGQGTLVTVSS |
| 104 | ABP29 | V_H | QVQLQESGPGLVKPSETLSLTCAVSGYSISSEYMWGWIRQPPGK GLEWIGLIYHSGKTYYNPSLKSRVTISVDTSKNQFSLKLSSVTAA DTAVYYCARDSGRGYGDYGGHHAFDIWGQGTMVTVSS |
| 105 | ABP30 | V_H | QVQLQESGPGLVKPSQTLSLTCTVSGGSISSGGAVVVSWIRQHPG KGLEWIGGIAYSGSTYYNPSLKSRVTISVDTSKNQFSLKLSSVTA ADTAVYYCARDSVRGYGDYGGHHAFDIWGQGTMVTVSS |
| 104 | ABP31 | V_H | QVQLQESGPGLVKPSETLSLTCAVSGYSISSEYMWGWIRQPPGK GLEWIGLIYHSGKTYYNPSLKSRVTISVDTSKNQFSLKLSSVTAA DTAVYYCARDSGRGYGDYGGHHAFDIWGQGTMVTVSS |
| 105 | ABP32 | V_H | QVQLQESGPGLVKPSQTLSLTCTVSGGSISSGGAVVVSWIRQHPG KGLEWIGGIAYSGSTYYNPSLKSRVTISVDTSKNQFSLKLSSVTA ADTAVYYCARDSVRGYGDYGGHHAFDIWGQGTMVTVSS |
| 126 | ABP33 | V_H Variable 1 | QVQLVQSGAEVKKPGASVKVSCKASGYTFTSYYMHWVRQAPG QGLEWMGIINPSGGSTTYAQKFQGRVTMTRDTSTSTVYMELSSL RSEDTAVYYCARGQYGYYGGRLDVVVGQGTTVTVSS |
| 126 | ABP34 | V_H Variable 1 | QVQLVQSGAEVKKPGASVKVSCKASGYTFTSYYMHWVRQAPG QGLEWMGIINPSGGSTTYAQKFQGRVTMTRDTSTSTVYMELSSL RSEDTAVYYCARGQYGYYGGRLDVWGQGTTVTVSS |
| 127 | ABP33 | V_H Variable 2 | QVQLVESGGGVVQPGRSLRLSCAASGFTFSSYGMHWVRQAPG KGLEWVAVISYDGSNKYYADSVKGRFTISRDNSKNTLYLQMNS LRAEDTAVYYCARDGLGYMAWGQGTTVTVSS |
| 127 | ABP34 | V_H Variable 2 | QVQLVESGGGVVQPGRSLRLSCAASGFTFSSYGMHWVRQAPG KGLEWVAVISYDGSNKYYADSVKGRFTISRDNSKNTLYLQMNS LRAEDTAVYYCARDGLGYMAWGQGTTVTVSS |

APPENDIX A-continued

SEQUENCES

| SEQ ID NO | Molecule | Description | SEQUENCE |
|---|---|---|---|
| 10 | ABP1 | $V_L$ | DIQMTQSPSSLSASVGDRVTITCRASQSISSYLNWYQQKPGKAP KLLIYAASSLQSGVPSRFSGSGSGTDFTLTISSLQPEDFATYYCQQ EYATPPTFGGGTKVEIK |
| 20 | ABP2 | $V_L$ | DIQMTQSPSSLSASVGDRVTITCRASQSISSYLNWYQQKPGKAP KLLIYAASSLQSGVPSRFSGSGSGTDFTLTISSLQPEDFATYYCQQ EYNTPPTFGGGTKVEIK |
| 27 | ABP3 | $V_L$ | DIQMTQSPSSLSASVGDRVTITCRASQSISSYLNWYQQKPGKAP KLLIYAASSLKYGVPSRFSGSGSGTDFTLTISSLQPEDFATYYCQ QEYNTPPTFGGGTKVEIK |
| 35 | ABP4 | $V_L$ | DIQMTQSPSSLSASVGDRVTITCRASKSIDSYLNWYQQKPGKAP KLLIYAASSLQSGVPSRFSGSGSGTDFTLTISSLQPEDFATYYCQQ EYNTPPTFGGGTKVEIK |
| 35 | ABP5 | $V_L$ | DIQMTQSPSSLSASVGDRVTITCRASKSIDSYLNWYQQKPGKAP KLLIYAASSLQSGVPSRFSGSGSGTDFTLTISSLQPEDFATYYCQQ EYNTPPTFGGGTKVEIK |
| 40 | ABP6 | $V_L$ | DIQMTQSPSSLSASVGDRVTITCRASQSISSYLNWYQQKPGKAP KLLIYAADSLQSGVPSRFSGSGSGTDFTLTISSLQPEDFATYYCQ QEYNTPPTFGGGTKVEIK |
| 45 | ABP7 | $V_L$ | DIQMTQSPSSLSASVGDRVTITCRASQSINYLNWYQQKPGKAP KLLIYAASSLDSGVPSRFSGSGSGTDFTLTISSLQPEDFATYYCQQ EYNTPPTFGGGTKVEIK |
| 53 | ABP8 | $V_L$ | DIQMTQSPSSLSASVGDRVTITCGASQSISTYLNWYQQKPGKAP KLLIYSASSLESGVPSRFSGSGSGTDFTLTISSLQPEDFATYYCQQ EYNTPPSFGGGTKVEIK |
| 10 | ABP9 | $V_L$ | DIQMTQSPSSLSASVGDRVTITCRASQSISSYLNWYQQKPGKAP KLLIYAASSLQSGVPSRFSGSGSGTDFTLTISSLQPEDFATYYCQQ EYATPPTFGGGTKVEIK |
| 10 | ABP10 | $V_L$ | DIQMTQSPSSLSASVGDRVTITCRASQSISSYLNWYQQKPGKAP KLLIYAASSLQSGVPSRFSGSGSGTDFTLTISSLQPEDFATYYCQQ EYATPPTFGGGTKVEIK |
| 63 | ABP11 | $V_L$ | DIVIVITQSPLSLPVTPGEPASISCRSSQSLLHSNGYNYLDWYLQKP GQSPQLLIYLGSNRASGVPDRFSGSGSGTDFTLKISRVEAEDVGV YYCMQKIGTPLTFGGGTKVEIK |
| 63 | ABP12 | $V_L$ | DIVIVITQSPLSLPVTPGEPASISCRSSQSLLHSNGYNYLDWYLQKP GQSPQLLIYLGSNRASGVPDRFSGSGSGTDFTLKISRVEAEDVGV YYCMQKIGTPLTFGGGTKVEIK |
| 72 | ABP13 | $V_L$ | DIQLTQSPSSVSASVGDRVTITCRASQGISSWLAWYQQKPGKAP KLLIYGASSLQSGVPSRFSGSGSGTDFTLTISSLQPEDFATYYCQQ ASLFPPTFGGGTKVEIK |
| 80 | ABP14 | $V_L$ | EIVLTQSPATLSLSPGERATLSCRASQSVSSYLAWYQQKPGQAP RLLIYDASNRATGIPARFSGSGSGTDFTLTISSLEPEDFAVYYCQQ RLVFPPTFGGGTKVEIK |
| 80 | ABP15 | $V_L$ | EIVLTQSPATLSLSPGERATLSCRASQSVSSYLAWYQQKPGQAP RLLIYDASNRATGIPARFSGSGSGTDFTLTISSLEPEDFAVYYCQQ RLVFPPTFGGGTKVEIK |
| 80 | ABP16 | $V_L$ | EIVLTQSPATLSLSPGERATLSCRASQSVSSYLAWYQQKPGQAP RLLIYDASNRATGIPARFSGSGSGTDFTLTISSLEPEDFAVYYCQQ RLVFPPTFGGGTKVEIK |
| 90 | ABP17 | $V_L$ | EIVLTQSPATLSLSPGERATLSCRASQSVSSYLAWYQQKPGQAP RLLIYDASNRATGIPARFSGSGSGTDFTLTISSLEPEDFAVYYCQQ HSVFPPTFGGGTKVEIK |
| 90 | ABP18 | $V_L$ | EIVLTQSPATLSLSPGERATLSCRASQSVSSYLAWYQQKPGQAP RLLIYDASNRATGIPARFSGSGSGTDFTLTISSLEPEDFAVYYCQQ HSVFPPTFGGGTKVEIK |

APPENDIX A-continued

SEQUENCES

| SEQ ID NO | Molecule | Description | SEQUENCE |
|---|---|---|---|
| 63 | ABP19 | $V_L$ | DIVIVITQSPLSLPVTPGEPASISCRSSQSLLHSNGYNYLDWYLQKP GQSPQLLIYLGSNRASGVPDRFSGSGSGTDFTLKISRVEAEDVGV YYCMQKIGTPLTFGGGTKVEIK |
| 72 | ABP20 | $V_L$ | DIQLTQSPSSVSASVGDRVTITCRASQGISSWLAWYQQKPGKAP KLLIYGASSLQSGVPSRFSGSGSGTDFTLTISSLQPEDFATYYCQQ ASLFPPTFGGGTKVEIK |
| 80 | ABP21 | $V_L$ | EIVLTQSPATLSLSPGERATLSCRASQSVSSYLAWYQQKPGQAP RLLIYDASNRATGIPARFSGSGSGTDFTLTISSLEPEDFAVYYCQQ RLVFPPTFGGGTKVEIK |
| 90 | ABP22 | $V_L$ | EIVLTQSPATLSLSPGERATLSCRASQSVSSYLAWYQQKPGQAP RLLIYDASNRATGIPARFSGSGSGTDFTLTISSLEPEDFAVYYCQQ HSVFPPTFGGGTKVEIK |
| 10 | ABP23 | $V_L$ | DIQMTQSPSSLSASVGDRVTITCRASQSISSYLNWYQQKPGKAP KLLIYAASSLQSGVPSRFSGSGSGTDFTLTISSLQPEDFATYYCQQ EYATPPTFGGGTKVEIK |
| 10 | ABP24 | $V_L$ | DIQMTQSPSSLSASVGDRVTITCRASQSISSYLNWYQQKPGKAP KLLIYAASSLQSGVPSRFSGSGSGTDFTLTISSLQPEDFATYYCQQ EYATPPTFGGGTKVEIK |
| 63 | ABP25 | $V_L$ | DIVIVITQSPLSLPVTPGEPASISCRSSQSLLHSNGYNYLDWYLQKP GQSPQLLIYLGSNRASGVPDRFSGSGSGTDFTLKISRVEAEDVGV YYCMQKIGTPLTFGGGTKVEIK |
| 72 | ABP26 | $V_L$ | DIQLTQSPSSVSASVGDRVTITCRASQGISSWLAWYQQKPGKAP KLLIYGASSLQSGVPSRFSGSGSGTDFTLTISSLQPEDFATYYCQQ ASLFPPTFGGGTKVEIK |
| 80 | ABP27 | $V_L$ | EIVLTQSPATLSLSPGERATLSCRASQSVSSYLAWYQQKPGQAP RLLIYDASNRATGIPARFSGSGSGTDFTLTISSLEPEDFAVYYCQQ RLVFPPTFGGGTKVEIK |
| 90 | ABP28 | $V_L$ | EIVLTQSPATLSLSPGERATLSCRASQSVSSYLAWYQQKPGQAP RLLIYDASNRATGIPARFSGSGSGTDFTLTISSLEPEDFAVYYCQQ HSVFPPTFGGGTKVEIK |
| 10 | ABP29 | $V_L$ | DIQMTQSPSSLSASVGDRVTITCRASQSISSYLNWYQQKPGKAP KLLIYAASSLQSGVPSRFSGSGSGTDFTLTISSLQPEDFATYYCQQ EYATPPTFGGGTKVEIK |
| 10 | ABP30 | $V_L$ | DIQMTQSPSSLSASVGDRVTITCRASQSISSYLNWYQQKPGKAP KLLIYAASSLQSGVPSRFSGSGSGTDFTLTISSLQPEDFATYYCQQ EYATPPTFGGGTKVEIK |
| 10 | ABP31 | $V_L$ | DIQMTQSPSSLSASVGDRVTITCRASQSISSYLNWYQQKPGKAP KLLIYAASSLQSGVPSRFSGSGSGTDFTLTISSLQPEDFATYYCQQ EYATPPTFGGGTKVEIK |
| 10 | ABP32 | $V_L$ | DIQMTQSPSSLSASVGDRVTITCRASQSISSYLNWYQQKPGKAP KLLIYAASSLQSGVPSRFSGSGSGTDFTLTISSLQPEDFATYYCQQ EYATPPTFGGGTKVEIK |
| 128 | ABP33 | $V_L$ | DIVIVITQSPLSLPVTPGEPASISCRSSQSLLHSNGYNYLDWYLQKP GQSPQLLIYLGSNRASGVPDRFSGSGSGTDFTLKISRVEAEDVGV YYCMQALQTPITFGGGTKVEIK |
| 128 | ABP34 | $V_L$ | DIVIVITQSPLSLPVTPGEPASISCRSSQSLLHSNGYNYLDWYLQKP GQSPQLLIYLGSNRASGVPDRFSGSGSGTDFTLKISRVEAEDVGV YYCMQALQTPITFGGGTKVEIK |
| 13 | ABP1 | $V_H$ CDR3 | AHERVRGYGDYGGHHAFDI |
| 23 | ABP2 | $V_H$ CDR3 | ADENVRGYGDYGGHHAFDI |
| 30 | ABP3 | $V_H$ CDR3 | VLESVRGYGDYGGHHAFDI |
| 30 | ABP4 | $V_H$ CDR3 | VLESVRGYGDYGGHHAFDI |
| 30 | ABP5 | $V_H$ CDR3 | VLESVRGYGDYGGHHAFDI |

APPENDIX A-continued

SEQUENCES

| SEQ ID NO | Molecule | Description | SEQUENCE |
|---|---|---|---|
| 30 | ABP6 | $V_H$ CDR3 | VLESVRGYGDYGGHHAFDI |
| 48 | ABP7 | $V_H$ CDR3 | AREADRGYGDYGGHHAFDI |
| 48 | ABP8 | $V_H$ CDR3 | AREADRGYGDYGGHHAFDI |
| 61 | ABP9 | $V_H$ CDR3 | ARDSGRGYGDYGGHHAFDI |
| 61 | ABP10 | $V_H$ CDR3 | ARDSGRGYGDYGGHHAFDI |
| 66 | ABP11 | $V_H$ CDR3 | ARAGGGYARGDHYYGMDV |
| 66 | ABP12 | $V_H$ CDR3 | ARAGGGYARGDHYYGMDV |
| 75 | ABP13 | $V_H$ CDR3 | ARQSDYGLPRGMDV |
| 83 | ABP14 | $V_H$ CDR3 | AREGGHYYSGWPY |
| 83 | ABP15 | $V_H$ CDR3 | AREGGHYYSGWPY |
| 83 | ABP16 | $V_H$ CDR3 | AREGGHYYSGWPY |
| 93 | ABP17 | $V_H$ CDR3 | AREGYYYGALPY |
| 93 | ABP18 | $V_H$ CDR3 | AREGYYYGALPY |
| 66 | ABP19 | $V_H$ CDR3 | ARAGGGYARGDHYYGMDV |
| 75 | ABP20 | $V_H$ CDR3 | ARQSDYGLPRGMDV |
| 83 | ABP21 | $V_H$ CDR3 | AREGGHYYSGWPY |
| 93 | ABP22 | $V_H$ CDR3 | AREGYYYGALPY |
| 61 | ABP23 | $V_H$ CDR3 | ARDSGRGYGDYGGHHAFDI |
| 103 | ABP24 | $V_H$ CDR3 | ARDSVRGYGDYGGHHAFDI |
| 66 | ABP25 | $V_H$ CDR3 | ARAGGGYARGDHYYGMDV |
| 75 | ABP26 | $V_H$ CDR3 | ARQSDYGLPRGMDV |
| 83 | ABP27 | $V_H$ CDR3 | AREGGHYYSGWPY |
| 93 | ABP28 | $V_H$ CDR3 | AREGYYYGALPY |
| 61 | ABP29 | $V_H$ CDR3 | ARDSGRGYGDYGGHHAFDI |
| 103 | ABP30 | $V_H$ CDR3 | ARDSVRGYGDYGGHHAFDI |
| 61 | ABP31 | $V_H$ CDR3 | ARDSGRGYGDYGGHHAFDI |
| 103 | ABP32 | $V_H$ CDR3 | ARDSVRGYGDYGGHHAFDI |
| 131 | ABP33 | $V_H$ CDR3 v1 | ARGQYGYYGGRLDV |
| 131 | ABP34 | $V_H$ CDR3 v1 | ARGQYGYYGGRLDV |
| 134 | ABP33 | $V_H$ CDR3 v2 | ARDGLGYMA |
| 134 | ABP34 | $V_H$ CDR3 v2 | ARDGLGYMA |
| 12 | ABP1 | $V_H$ CDR2 | GIYESGSTYYNPSLKS |
| 22 | ABP2 | $V_H$ CDR2 | GIAYSGSTYYNPSLKS |
| 29 | ABP3 | $V_H$ CDR2 | LIVHSGSTYYNPSLKS |
| 29 | ABP4 | $V_H$ CDR2 | LIVHSGSTYYNPSLKS |
| 29 | ABP5 | $V_H$ CDR2 | LIVHSGSTYYNPSLKS |
| 29 | ABP6 | $V_H$ CDR2 | LIVHSGSTYYNPSLKS |

APPENDIX A-continued

SEQUENCES

| SEQ ID NO | Molecule | Description | SEQUENCE |
|---|---|---|---|
| 47 | ABP7 | V<sub>H</sub> CDR2 | LIYHSGKTYYNPSLKS |
| 47 | ABP8 | V<sub>H</sub> CDR2 | LIYHSGKTYYNPSLKS |
| 60 | ABP9 | V<sub>H</sub> CDR2 | SIYYSGSTYYNPSLKS |
| 60 | ABP10 | V<sub>H</sub> CDR2 | SIYYSGSTYYNPSLKS |
| 65 | ABP11 | V<sub>H</sub> CDR2 | GIIPVPGTANYAQKFQG |
| 65 | ABP12 | V<sub>H</sub> CDR2 | GIIPVPGTANYAQKFQG |
| 74 | ABP13 | V<sub>H</sub> CDR2 | GIIPIEGTAYYAQKFQG |
| 82 | ABP14 | V<sub>H</sub> CDR2 | GIIPISGFTNYAQKFQG |
| 82 | ABP15 | V<sub>H</sub> CDR2 | GIIPISGFTNYAQKFQG |
| 82 | ABP16 | V<sub>H</sub> CDR2 | GIIPISGFTNYAQKFQG |
| 92 | ABP17 | V<sub>H</sub> CDR2 | GIIPIFGEAQYAQRFQG |
| 96 | ABP18 | V<sub>H</sub> CDR2 | GIIPIFGEAQYAQKFRG |
| 65 | ABP19 | V<sub>H</sub> CDR2 | GIIPVPGTANYAQKFQG |
| 74 | ABP20 | V<sub>H</sub> CDR2 | GIIPIEGTAYYAQKFQG |
| 100 | ABP21 | V<sub>H</sub> CDR2 | GIIPISGFANYAQKFQG |
| 102 | ABP22 | V<sub>H</sub> CDR2 | GIIPIFGEAQYAQKFQG |
| 47 | ABP23 | V<sub>H</sub> CDR2 | LIYHSGKTYYNPSLKS |
| 22 | ABP24 | V<sub>H</sub> CDR2 | GIAYSGSTYYNPSLKS |
| 65 | ABP25 | V<sub>H</sub> CDR2 | GIIPVPGTANYAQKFQG |
| 74 | ABP26 | V<sub>H</sub> CDR2 | GIIPIEGTAYYAQKFQG |
| 100 | ABP27 | V<sub>H</sub> CDR2 | GIIPISGFANYAQKFQG |
| 102 | ABP28 | V<sub>H</sub> CDR2 | GIIPIFGEAQYAQKFQG |
| 47 | ABP29 | V<sub>H</sub> CDR2 | LIYHSGKTYYNPSLKS |
| 22 | ABP30 | V<sub>H</sub> CDR2 | GIAYSGSTYYNPSLKS |
| 47 | ABP31 | V<sub>H</sub> CDR2 | LIYHSGKTYYNPSLKS |
| 22 | ABP32 | V<sub>H</sub> CDR2 | GIAYSGSTYYNPSLKS |
| 130 | ABP33 | V<sub>H</sub> CDR2 v1 | IINPSGGSTTYAQKFQG |
| 130 | ABP34 | V<sub>H</sub> CDR2 v1 | IINPSGGSTTYAQKFQG |
| 133 | ABP33 | V<sub>H</sub> CDR2 v2 | VISYDGSNKYYADSVKG |
| 133 | ABP34 | V<sub>H</sub> CDR2 v2 | VISYDGSNKYYADSVKG |
| 11 | ABP1 | V<sub>H</sub> CDR1 | YSISSGLGWG |
| 21 | ABP2 | V<sub>H</sub> CDR1 | GSISSGGAVVVS |
| 28 | ABP3 | V<sub>H</sub> CDR1 | YSISSGAGWG |
| 28 | ABP4 | V<sub>H</sub> CDR1 | YSISSGAGWG |
| 28 | ABP5 | V<sub>H</sub> CDR1 | YSISSGAGWG |
| 28 | ABP6 | V<sub>H</sub> CDR1 | YSISSGAGWG |
| 46 | ABP7 | V<sub>H</sub> CDR1 | YSISSEYMWG |

APPENDIX A-continued

SEQUENCES

| SEQ ID NO | Molecule | Description | SEQUENCE |
|---|---|---|---|
| 46 | ABP8 | $V_H$ CDR1 | YSISSEYMWG |
| 59 | ABP9 | $V_H$ CDR1 | GSISSSSYAWG |
| 59 | ABP10 | $V_H$ CDR1 | GSISSSSYAWG |
| 64 | ABP11 | $V_H$ CDR1 | GTFSSYYIS |
| 64 | ABP12 | $V_H$ CDR1 | GTFSSYYIS |
| 73 | ABP13 | $V_H$ CDR1 | GTFSRGAIS |
| 81 | ABP14 | $V_H$ CDR1 | GTFSSYAIS |
| 81 | ABP15 | $V_H$ CDR1 | GTFSSYAIS |
| 81 | ABP16 | $V_H$ CDR1 | GTFSSYAIS |
| 91 | ABP17 | $V_H$ CDR1 | GTFVRYAIS |
| 91 | ABP18 | $V_H$ CDR1 | GTFVRYAIS |
| 64 | ABP19 | $V_H$ CDR1 | GTFSSYYIS |
| 73 | ABP20 | $V_H$ CDR1 | GTFSRGAIS |
| 81 | ABP21 | $V_H$ CDR1 | GTFSSYAIS |
| 91 | ABP22 | $V_H$ CDR1 | GTFVRYAIS |
| 46 | ABP23 | $V_H$ CDR1 | YSISSEYMWG |
| 21 | ABP24 | $V_H$ CDR1 | GSISSGGAVVVS |
| 64 | ABP25 | $V_H$ CDR1 | GTFSSYYIS |
| 73 | ABP26 | $V_H$ CDR1 | GTFSRGAIS |
| 81 | ABP27 | $V_H$ CDR1 | GTFSSYAIS |
| 91 | ABP28 | $V_H$ CDR1 | GTFVRYAIS |
| 46 | ABP29 | $V_H$ CDR1 | YSISSEYMWG |
| 21 | ABP30 | $V_H$ CDR1 | GSISSGGAVVVS |
| 46 | ABP31 | $V_H$ CDR1 | YSISSEYMWG |
| 21 | ABP32 | $V_H$ CDR1 | GSISSGGAVVVS |
| 129 | ABP33 | $V_H$ CDR1 v1 | YTFTSYYMH |
| 129 | ABP34 | $V_H$ CDR1 v1 | YTFTSYYMH |
| 132 | ABP33 | $V_H$ CDR1 v2 | FTFSSYGMH |
| 132 | ABP34 | $V_H$ CDR1 v2 | FTFSSYGMH |
| 16 | ABP1 | $V_L$ CDR3 | QQEYATPPT |
| 17 | ABP2 | $V_L$ CDR3 | QQEYNTPPT |
| 17 | ABP3 | $V_L$ CDR3 | QQEYNTPPT |
| 17 | ABP4 | $V_L$ CDR3 | QQEYNTPPT |
| 17 | ABP5 | $V_L$ CDR3 | QQEYNTPPT |
| 17 | ABP6 | $V_L$ CDR3 | QQEYNTPPT |
| 17 | ABP7 | $V_L$ CDR3 | QQEYNTPPT |
| 56 | ABP8 | $V_L$ CDR3 | QQEYNTPPS |

APPENDIX A-continued

SEQUENCES

| SEQ ID NO | Molecule | Description | SEQUENCE |
|---|---|---|---|
| 16 | ABP9 | V$_L$ CDR3 | QQEYATPPT |
| 16 | ABP10 | V$_L$ CDR3 | QQEYATPPT |
| 69 | ABP11 | V$_L$ CDR3 | MQKIGTPLT |
| 69 | ABP12 | V$_L$ CDR3 | MQKIGTPLT |
| 78 | ABP13 | V$_L$ CDR3 | QQASLFPPT |
| 86 | ABP14 | V$_L$ CDR3 | QQRLVFPPT |
| 86 | ABP15 | V$_L$ CDR3 | QQRLVFPPT |
| 86 | ABP16 | V$_L$ CDR3 | QQRLVFPPT |
| 94 | ABP17 | V$_L$ CDR3 | QQHSVFPPT |
| 94 | ABP18 | V$_L$ CDR3 | QQHSVFPPT |
| 69 | ABP19 | V$_L$ CDR3 | MQKIGTPLT |
| 78 | ABP20 | V$_L$ CDR3 | QQASLFPPT |
| 86 | ABP21 | V$_L$ CDR3 | QQRLVFPPT |
| 94 | ABP22 | V$_L$ CDR3 | QQHSVFPPT |
| 16 | ABP23 | V$_L$ CDR3 | QQEYATPPT |
| 16 | ABP24 | V$_L$ CDR3 | QQEYATPPT |
| 69 | ABP25 | V$_L$ CDR3 | MQKIGTPLT |
| 78 | ABP26 | V$_L$ CDR3 | QQASLFPPT |
| 86 | ABP27 | V$_L$ CDR3 | QQRLVFPPT |
| 94 | ABP28 | V$_L$ CDR3 | QQHSVFPPT |
| 16 | ABP29 | V$_L$ CDR3 | QQEYATPPT |
| 16 | ABP30 | V$_L$ CDR3 | QQEYATPPT |
| 16 | ABP31 | V$_L$ CDR3 | QQEYATPPT |
| 16 | ABP32 | V$_L$ CDR3 | QQEYATPPT |
| 135 | ABP33 | V$_L$ CDR3 | MQALQTPIT |
| 135 | ABP34 | V$_L$ CDR3 | MQALQTPIT |
| 15 | ABP1 | V$_L$ CDR2 | AASSLQS |
| 15 | ABP2 | V$_L$ CDR2 | AASSLQS |
| 31 | ABP3 | V$_L$ CDR2 | AASSLKY |
| 15 | ABP4 | V$_L$ CDR2 | AASSLQS |
| 15 | ABP5 | V$_L$ CDR2 | AASSLQS |
| 41 | ABP6 | V$_L$ CDR2 | AADSLQS |
| 50 | ABP7 | V$_L$ CDR2 | AASSLDS |
| 55 | ABP8 | V$_L$ CDR2 | SASSLES |
| 15 | ABP9 | V$_L$ CDR2 | AASSLQS |
| 15 | ABP10 | V$_L$ CDR2 | AASSLQS |
| 68 | ABP11 | V$_L$ CDR2 | LGSNRAS |

APPENDIX A-continued

SEQUENCES

| SEQ ID NO | Molecule | Description | SEQUENCE |
|---|---|---|---|
| 68 | ABP12 | $V_L$ CDR2 | LGSNRAS |
| 77 | ABP13 | $V_L$ CDR2 | GASSLQS |
| 85 | ABP14 | $V_L$ CDR2 | DASNRAT |
| 85 | ABP15 | $V_L$ CDR2 | DASNRAT |
| 85 | ABP16 | $V_L$ CDR2 | DASNRAT |
| 85 | ABP17 | $V_L$ CDR2 | DASNRAT |
| 85 | ABP18 | $V_L$ CDR2 | DASNRAT |
| 68 | ABP19 | $V_L$ CDR2 | LGSNRAS |
| 77 | ABP20 | $V_L$ CDR2 | GASSLQS |
| 85 | ABP21 | $V_L$ CDR2 | DASNRAT |
| 85 | ABP22 | $V_L$ CDR2 | DASNRAT |
| 15 | ABP23 | $V_L$ CDR2 | AASSLQS |
| 15 | ABP24 | $V_L$ CDR2 | AASSLQS |
| 68 | ABP25 | $V_L$ CDR2 | LGSNRAS |
| 77 | ABP26 | $V_L$ CDR2 | GASSLQS |
| 85 | ABP27 | $V_L$ CDR2 | DASNRAT |
| 85 | ABP28 | $V_L$ CDR2 | DASNRAT |
| 15 | ABP29 | $V_L$ CDR2 | AASSLQS |
| 15 | ABP30 | $V_L$ CDR2 | AASSLQS |
| 15 | ABP31 | $V_L$ CDR2 | AASSLQS |
| 15 | ABP32 | $V_L$ CDR2 | AASSLQS |
| 68 | ABP33 | $V_L$ CDR2 | LGSNRAS |
| 68 | ABP34 | $V_L$ CDR2 | LGSNRAS |
| 14 | ABP1 | $V_L$ CDR1 | RASQSISSYLN |
| 14 | ABP2 | $V_L$ CDR1 | RASQSISSYLN |
| 14 | ABP3 | $V_L$ CDR1 | RASQSISSYLN |
| 36 | ABP4 | $V_L$ CDR1 | RASKSIDSYLN |
| 36 | ABP5 | $V_L$ CDR1 | RASKSIDSYLN |
| 14 | ABP6 | $V_L$ CDR1 | RASQSISSYLN |
| 49 | ABP7 | $V_L$ CDR1 | RASQSINSYLN |
| 54 | ABP8 | $V_L$ CDR1 | GASQSISTYLN |
| 14 | ABP9 | $V_L$ CDR1 | RASQSISSYLN |
| 14 | ABP10 | $V_L$ CDR1 | RASQSISSYLN |
| 67 | ABP11 | $V_L$ CDR1 | RSSQSLLHSNGYNYLD |
| 67 | ABP12 | $V_L$ CDR1 | RSSQSLLHSNGYNYLD |
| 76 | ABP13 | $V_L$ CDR1 | RASQGISSWLA |
| 84 | ABP14 | $V_L$ CDR1 | RASQSVSSYLA |

APPENDIX A-continued

SEQUENCES

| SEQ ID NO | Molecule | Description | SEQUENCE |
|---|---|---|---|
| 84 | ABP15 | $V_L$ CDR1 | RASQSVSSYLA |
| 84 | ABP16 | $V_L$ CDR1 | RASQSVSSYLA |
| 84 | ABP17 | $V_L$ CDR1 | RASQSVSSYLA |
| 84 | ABP18 | $V_L$ CDR1 | RASQSVSSYLA |
| 67 | ABP19 | $V_L$ CDR1 | RSSQSLLHSNGYNYLD |
| 76 | ABP20 | $V_L$ CDR1 | RASQGISSWLA |
| 84 | ABP21 | $V_L$ CDR1 | RASQSVSSYLA |
| 84 | ABP22 | $V_L$ CDR1 | RASQSVSSYLA |
| 14 | ABP23 | $V_L$ CDR1 | RASQSISSYLN |
| 14 | ABP24 | $V_L$ CDR1 | RASQSISSYLN |
| 67 | ABP25 | $V_L$ CDR1 | RSSQSLLHSNGYNYLD |
| 76 | ABP26 | $V_L$ CDR1 | RASQGISSWLA |
| 84 | ABP27 | $V_L$ CDR1 | RASQSVSSYLA |
| 84 | ABP28 | $V_L$ CDR1 | RASQSVSSYLA |
| 14 | ABP29 | $V_L$ CDR1 | RASQSISSYLN |
| 14 | ABP30 | $V_L$ CDR1 | RASQSISSYLN |
| 14 | ABP31 | $V_L$ CDR1 | RASQSISSYLN |
| 14 | ABP32 | $V_L$ CDR1 | RASQSISSYLN |
| 67 | ABP33 | $V_L$ CDR1 | RSSQSLLHSNGYNYLD |
| 67 | ABP34 | $V_L$ CDR1 | RSSQSLLHSNGYNYLD |
| 137 | IgG1 CH1 | Constant Region | ASTKGPSVFPLAPSSKSTSGGTAALGCLVKDYFPEPVTVSWNSG ALTSGVHTFPAVLQSSGLYSLSSVVTVPSSSLGTQTYICNVNHKP SNTKVDKRVEPKSC |
| 138 | IgG4 S228P | Constant Region | ASTKGPSVFPLAPCSRSTSESTAALGCLVKDYFPEPVTVSWNSG ALTSGVHTFPAVLQSSGLYSLSSVVTVPSSSLGTKTYTCNVDHK PSNTKVDKRVESKYGPPCPPCPAPEFLGGPSVFLFPPKPKDTLMI SRTPEVTCVVVDVSQEDPEVQFNWYVDGVEVHNAKTKPREEQF NSTYRVVSVLTVLHQDWLNGKEYKCKVSNKGLPSSIEKTISKAK GQPREPQVYTLPPSQEEMTKNQVSLTCLVKGFYPSDIAVEWESN GQPENNYKTTPPVLDSDGSFFLYSRLTVDKSRWQEGNVFSCSV MHEALHNHYTQKSLSLSLGK |
| 139 | IgG4 S228P no C terminal Lys | Constant Region | ASTKGPSVFPLAPCSRSTSESTAALGCLVKDYFPEPVTVSWNSG ALTSGVHTFPAVLQSSGLYSLSSVVTVPSSSLGTKTYTCNVDHK PSNTKVDKRVESKYGPPCPPCPAPEFLGGPSVFLFPPKPKDTLMI SRTPEVTCVVVDVSQEDPEVQFNWYVDGVEVHNAKTKPREEQF NSTYRVVSVLTVLHQDWLNGKEYKCKVSNKGLPSSIEKTISKAK GQPREPQVYTLPPSQEEMTKNQVSLTCLVKGFYPSDIAVEWESN GQPENNYKTTPPVLDSDGSFFLYSRLTVDKSRWQEGNVFSCSV MHEALHNHYTQKSLSLSLG |
| 140 | Kappa | Constant Region | RTVAAPSVFIFPPSDEQLKSGTASVVCLLNNFYPREAKVQWKVD NALQSGNSQESVTEQDSKDSTYSLSSTLTLSKADYEKHKVYACE VTHQGLSSPVTKSFNRGEC |
| 141 | CDRH3 | Generic Sequence 1 | $X_1X_2X_3X_4X_5$RGYGDYGGHHAFDI, WHEREIN $X_1$ IS A OR V, $X_2$ IS H, D, L, OR R, $X_3$ IS E OR D, $X_4$ IS R, N, S, OR A, AND $X_5$ IS V, D OR G |
| 142 | CDRH2 | Generic Sequence 1 | $X_1IX_2X_3SGX_4$TYYNPSLKS, WHEREIN $X_1$ IS G, L, OR S, $X_2$ IS Y, A, OR V, $X_3$ IS E, Y OR H, AND $X_4$ IS S OR K |

APPENDIX A-continued

SEQUENCES

| SEQ ID NO | Molecule | Description | SEQUENCE |
|---|---|---|---|
| 143 | CDRH1 | Generic Sequence 1 | $X_1$SISS$X_2X_3X_4X_5$W$X_6$, WHEREIN $X_1$ IS Y OR G, $X_2$ IS G, S, ORE, $X_3$ IS L, G, S, Y, OR A, $X_4$ IS G, A, Y, OR M, $X_5$ IS V, A, OR IS ABSENT, AND $X_6$ IS S OR G |
| 144 | CDRL3 | Generic Sequence 1 | QQEY$X_1$TPP$X_2$, WHEREIN $X_1$ IS A OR N AND $X_2$ IS T OR S |
| 145 | CDRL2 | Generic Sequence 1 | $X_1$A$X_2$SL$X_3X_4$, WHEREIN $X_1$ IS A OR S, $X_2$ IS D OR S, $X_3$ IS Q, D, K, OR E, AND $X_4$ IS S OR Y |
| 146 | CDRL1 | Generic Sequence 1 | $X_1$AS$X_2$SI$X_3X_4$YLN, WHEREIN $X_1$ IS G OR R, $X_2$ IS Q OR K, $X_3$ IS S, D, OR N, AND X4 IS S OR T |
| 147 | CDRH2 | Generic Sequence 2 | GIIPIFGEAQYAQ$X_1$F$X_2$G, WHEREIN $X_1$ IS K OR R, AND $X_2$ IS Q OR R |
| 148 | ABP35 | Full Heavy, IgG1 N297A | QVQLQESGPGLVKPSETLSLTCAVSGYSISSGLGWGWIRQPPGK GLEWIGGIYESGSTYYNPSLKSRVTISVDTSKNQFSLKLSSVTAA DTAVYYCAHERVRGYGDYGGHHAFDIWGQGTMVTVSSASTKG PSVFPLAPSSKSTSGGTAALGCLVKDYFPEPVTVSWNSGALTSG VHTFPAVLQSSGLYSLSSVVTVPSSSLGTQTYICNVNHKPSNTKV DKKVEPKSCDKTHTCPPCPAPELLGGPSVFLFPPKPKDTLMISRT PEVTCVVVDVSHEDPEVKFNWYVDGVEVHNAKTKPREEQYAS TYRVVSVLTVLHQDWLNGKEYKCKVSNKALPAPIEKTISKAKG QPREPQVYTLPPSRDELTKNQVSLTCLVKGFYPSDIAVEWESNG QPENNYKTTPPVLDSDGSFFLYSKLTVDKSRWQQGNVFSCSVM HEALHNHYTQKSLSLSPGK |
| 149 | ABP36 | Full Heavy, IgG1 N297A | QVQLQESGPGLVKPSQTLSLTCTVSGGSISSGGAVVVSWIRQHPG KGLEWIGGIAYSGSTYYNPSLKSRVTISVDTSKNQFSLKLSSVTA ADTAVYYCADENVRGYGDYGGHHAFDIWGQGTMVTVSSAST KGPSVFPLAPSSKSTSGGTAALGCLVKDYFPEPVTVSWNSGALT SGVHTFPAVLQSSGLYSLSSVVTVPSSSLGTQTYICNVNHKPSNT KVDKKVEPKSCDKTHTCPPCPAPELLGGPSVFLFPPKPKDTLMIS RTPEVTCVVVDVSHEDPEVKFNWYVDGVEVHNAKTKPREEQY ASTYRVVSVLTVLHQDWLNGKEYKCKVSNKALPAPIEKTISKA KGQPREPQVYTLPPSRDELTKNQVSLTCLVKGFYPSDIAVEWES NGQPENNYKTTPPVLDSDGSFFLYSKLTVDKSRWQQGNVFSCS VMHEALHNHYTQKSLSLSPGK |
| 150 | ABP37 | Full Heavy, IgG1 N297A | QVQLQESGPGLVKPSETLSLTCAVSGYSISSGAGWGWIRQPPGK GLEWIGLIVHSGSTYYNPSLKSRVTISVDTSKNQFSLKLSSVTAA DTAVYYCVLESVRGYGDYGGHHAFDIWGQGTMVTVSSASTKG PSVFPLAPSSKSTSGGTAALGCLVKDYFPEPVTVSWNSGALTSG VHTFPAVLQSSGLYSLSSVVTVPSSSLGTQTYICNVNHKPSNTKV DKKVEPKSCDKTHTCPPCPAPELLGGPSVFLFPPKPKDTLMISRT PEVTCVVVDVSHEDPEVKFNWYVDGVEVHNAKTKPREEQYAS TYRVVSVLTVLHQDWLNGKEYKCKVSNKALPAPIEKTISKAKG QPREPQVYTLPPSRDELTKNQVSLTCLVKGFYPSDIAVEWESNG QPENNYKTTPPVLDSDGSFFLYSKLTVDKSRWQQGNVFSCSVM HEALHNHYTQKSLSLSPGK |
| 151 | ABP38 | Full Heavy, IgG1 N297A | QVQLQESGPGLVKPSETLSLTCAVSGYSISSGAGWGWIRQPPGK GPEWIGLIVHSGSTYYNPSLKSRVTISVDTSKNQFSLKLSSVTAA DTAVYYCVLESVRGYGDYGGHHAFDIWGQGTMVTVSSASTKG PSVFPLAPSSKSTSGGTAALGCLVKDYFPEPVTVSWNSGALTSG VHTFPAVLQSSGLYSLSSVVTVPSSSLGTQTYICNVNHKPSNTKV DKKVEPKSCDKTHTCPPCPAPELLGGPSVFLFPPKPKDTLMISRT PEVTCVVVDVSHEDPEVKFNWYVDGVEVHNAKTKPREEQYAS TYRVVSVLTVLHQDWLNGKEYKCKVSNKALPAPIEKTISKAKG QPREPQVYTLPPSRDELTKNQVSLTCLVKGFYPSDIAVEWESNG QPENNYKTTPPVLDSDGSFFLYSKLTVDKSRWQQGNVFSCSVM HEALHNHYTQKSLSLSPGK |
| 152 | ABP39 | Full Heavy, IgG1 N297A | QVQLQESGPGLVKPSETLSLTCAVSGYSISSGAGWGWIRQPPGK GLEWIGLIVHSGSTYYNPSLKSRVTISVDTSKNQFSLKLSSVTAA DTAVYYCVLESVRGYGDYGGHHAFDIWGQGTMVTVSSASTKG PSVFPLAPSSKSTSGGTAALGCLVKDYFPEPVTVSWNSGALTSG VHTFPAVLQSSGLYSLSSVVTVPSSSLGTQTYICNVNHKPSNTKV DKKVEPKSCDKTHTCPPCPAPELLGGPSVFLFPPKPKDTLMISRT PEVTCVVVDVSHEDPEVKFNWYVDGVEVHNAKTKPREEQYAS TYRVVSVLTVLHQDWLNGKEYKCKVSNKALPAPIEKTISKAKG |

APPENDIX A-continued

SEQUENCES

| SEQ ID NO | Molecule | Description | SEQUENCE |
|---|---|---|---|
| | | | QPREPQVYTLPPSRDELTKNQVSLTCLVKGFYPSDIAVEWESNG QPENNYKTTPPVLDSDGSFFLYSKLTVDKSRWQQGNVFSCSVM HEALHNHYTQKSLSLSPGK |
| 153 | ABP40 | Full Heavy, IgG1 N297A | QVQLQESGPGLVKPSETLSLTCAVSGYSISSEYMWGWIRQPPGK GLEWIGLIYHSGKTYYNPSLKSRVTISVDTSKNQFSLKLSSVTAA DTAVYYCAREADRGYGDYGGHHAFDIWGQGTMVTVSSASTKG PSVFPLAPSSKSTSGGTAALGCLVKDYFPEPVTVSWNSGALTSG VHTFPAVLQSSGLYSLSSVVTVPSSSLGTQTYICNVNHKPSNTKV DKKVEPKSCDKTHTCPPCPAPELLGGPSVFLFPPKPKDTLMISRT PEVTCVVVDVSHEDPEVKFNWYVDGVEVHNAKTKPREEQYAS TYRVVSVLTVLHQDWLNGKEYKCKVSNKALPAPIEKTISKAKG QPREPQVYTLPPSRDELTKNQVSLTCLVKGFYPSDIAVEWESNG QPENNYKTTPPVLDSDGSFFLYSKLTVDKSRWQQGNVFSCSVM HEALHNHYTQKSLSLSPGK |
| 154 | ABP41 | Full Heavy, IgG1 N297A | QVQLQESGPGLVKPSETLSLTCAVSGYSISSEYMWGWIRQPPGK GLEWIGLIYHSGKTYYNPSLKSRVTISVDTSKNQFSLKLSSVTAA DTAVYYCAREADRGYGDYGGHHAFDIWGQGTMVTVSSASTKG PSVFPLAPSSKSTSGGTAALGCLVKDYFPEPVTVSWNSGALTSG VHTFPAVLQSSGLYSLSSVVTVPSSSLGTQTYICNVNHKPSNTKV DKKVEPKSCDKTHTCPPCPAPELLGGPSVFLFPPKPKDTLMISRT PEVTCVVVDVSHEDPEVKFNWYVDGVEVHNAKTKPREEQYAS TYRVVSVLTVLHQDWLNGKEYKCKVSNKALPAPIEKTISKAKG QPREPQVYTLPPSRDELTKNQVSLTCLVKGFYPSDIAVEWESNG QPENNYKTTPPVLDSDGSFFLYSKLTVDKSRWQQGNVFSCSVM HEALHNHYTQKSLSLSPGK |
| 155 | ABP42 | Full Heavy, IgG1 N297A | QLQLQESGPGLVKPSETLSLTCTVSGGSISSSSYAWGWIRQPPGK GLEWIGSIYYSGSTYYNPSLKSRVTISVDTSKNQFSLKLSSVTAA DTAVYYCARDSGRGYGDYGGHHAFDIWGQGTMVTVSSASTKG PSVFPLAPSSKSTSGGTAALGCLVKDYFPEPVTVSWNSGALTSG VHTFPAVLQSSGLYSLSSVVTVPSSSLGTQTYICNVNHKPSNTKV DKKVEPKSCDKTHTCPPCPAPELLGGPSVFLFPPKPKDTLMISRT PEVTCVVVDVSHEDPEVKFNWYVDGVEVHNAKTKPREEQYAS TYRVVSVLTVLHQDWLNGKEYKCKVSNKALPAPIEKTISKAKG QPREPQVYTLPPSRDELTKNQVSLTCLVKGFYPSDIAVEWESNG QPENNYKTTPPVLDSDGSFFLYSKLTVDKSRWQQGNVFSCSVM HEALHNHYTQKSLSLSPGK |
| 156 | ABP43 | Full Heavy, IgG4 S228P | QLQLQESGPGLVKPSETLSLTCTVSGGSISSSSYAWGWIRQPPGK GLEWIGSIYYSGSTYYNPSLKSRVTISVDTSKNQFSLKLSSVTAA DTAVYYCARDSGRGYGDYGGHHAFDIWGQGTMVTVSSASTKG PSVFPLAPCSRSTSESTAALGCLVKDYFPEPVTVSWNSGALTSGV HTFPAVLQSSGLYSLSSVVTVPSSSLGTKTYTCNVDHKPSNTKV DKRVESKYGPPCPPCPAPEFLGGPSVFLFPPKPKDTLMISRTPEVT CVVVDVSQEDPEVQFNWYVDGVEVHNAKTKPREEQFNSTYRV VSVLTVLHQDWLNGKEYKCKVSNKGLPSSIEKTISKAKGQPREP QVYTLPPSQEEMTKNQVSLTCLVKGFYPSDIAVEWESNGQPEN NYKTTPPVLDSDGSFFLYSRLTVDKSRWQEGNVFSCSVMHEAL HNHYTQKSLSLSLGK |
| 157 | ABP44 | Full Heavy, IgG1 N297A | QVQLVQSGAEVKKPGSSVKVSCKASGGTFSSYYISWVRQAPGQ GLEWMGGIIPVPGTANYAQKFQGRVTITADESTSTAYMELSSLR SEDTAVYYCARAGGGYARGDHYYGMDVVVGQGTTVTVSSAST KGPSVFPLAPSSKSTSGGTAALGCLVKDYFPEPVTVSWNSGALT SGVHTFPAVLQSSGLYSLSSVVTVPSSSLGTQTYICNVNHKPSNT KVDKKVEPKSCDKTHTCPPCPAPELLGGPSVFLFPPKPKDTLMIS RTPEVTCVVVDVSHEDPEVKFNWYVDGVEVHNAKTKPREEQY ASTYRVVSVLTVLHQDWLNGKEYKCKVSNKALPAPIEKTISKA KGQPREPQVYTLPPSRDELTKNQVSLTCLVKGFYPSDIAVEWES NGQPENNYKTTPPVLDSDGSFFLYSKLTVDKSRWQQGNVFSCS VMHEALHNHYTQKSLSLSPGK |
| 158 | ABP45 | Full Heavy, IgG1 N297A | QVQLVQSGAEVKKPGSSVKVSCKASGGTFSRGAISWVRQAPGQ GLEWMGGIIPIEGTAYYAQKFQGRVTITADESTSTAYMELSSLRS EDTAVYYCARQSDYGLPRGMDVVVGQGTTVTVSSASTKGPSVF PLAPSSKSTSGGTAALGCLVKDYFPEPVTVSWNSGALTSGVHTF PAVLQSSGLYSLSSVVTVPSSSLGTQTYICNVNHKPSNTKVDKK VEPKSCDKTHTCPPCPAPELLGGPSVFLFPPKPKDTLMISRTPEVT CVVVDVSHEDPEVKFNWYVDGVEVHNAKTKPREEQYASTYRV VSVLTVLHQDWLNGKEYKCKVSNKALPAPIEKTISKAKGQPREP |

APPENDIX A-continued

SEQUENCES

| SEQ ID NO | Molecule | Description | SEQUENCE |
|---|---|---|---|
| | | | QVYTLPPSRDELTKNQVSLTCLVKGFYPSDIAVEWESNGQPENN YKTTPPVLDSDGSFFLYSKLTVDKSRWQQGNVFSCSVMHEALH NHYTQKSLSLSPGK |
| 159 | ABP46 | Full Heavy, IgG1 N297A | QVQLVQSGAEVKKPGSSVKVSCKASGGTFSSYAISWVRQAPGQ GLEWMGGIIPISGFANYAQKFQGRVTITADESTSTAYMELSSLRS EDTAVYYCAREGGHYYSGWPYWGQGTLVTVSSASTKGPSVFP LAPSSKSTSGGTAALGCLVKDYFPEPVTVSWNSGALTSGVHTFP AVLQSSGLYSLSSVVTVPSSSLGTQTYICNVNHKPSNTKVDKKV EPKSCDKTHTCPPCPAPELLGGPSVFLFPPKPKDTLMISRTPEVTC VVVDVSHEDPEVKFNWYVDGVEVHNAKTKPREEQYASTYRVV SVLTVLHQDWLNGKEYKCKVSNKALPAPIEKTISKAKGQPREPQ VYTLPPSRDELTKNQVSLTCLVKGFYPSDIAVEWESNGQPENNY KTTPPVLDSDGSFFLYSKLTVDKSRWQQGNVFSCSVMHEALHN HYTQKSLSLSPGK |
| 160 | ABP47 | Full Heavy, IgG1 N297A | QVQLVQSGAEVKKPGSSVKVSCKASGGTFVRYAISWVRQAPGQ GLEWMGGIIPIFGEAQYAQKFQGRVTITADESTSTAYMELSSLRS EDTAVYYCAREGYYYGALPYWGQGTLVTVSSASTKGPSVFPLA PSSKSTSGGTAALGCLVKDYFPEPVTVSWNSGALTSGVHTFPAV LQSSGLYSLSSVVTVPSSSLGTQTYICNVNHKPSNTKVDKKVEP KSCDKTHTCPPCPAPELLGGPSVFLFPPKPKDTLMISRTPEVTCV VVDVSHEDPEVKFNWYVDGVEVHNAKTKPREEQYASTYRVVS VLTVLHQDWLNGKEYKCKVSNKALPAPIEKTISKAKGQPREPQ VYTLPPSRDELTKNQVSLTCLVKGFYPSDIAVEWESNGQPENNY KTTPPVLDSDGSFFLYSKLTVDKSRWQQGNVFSCSVMHEALHN HYTQKSLSLSPGK |
| 161 | ABP48 | Full Heavy, IgG1 N297A | QVQLQESGPGLVKPSETLSLTCAVSGYSISSEYMWGWIRQPPGK GLEWIGLIYHSGKTYYNPSLKSRVTISVDTSKNQFSLKLSSVTAA DTAVYYCARDSGRGYGDYGGHHAFDIWGQGTMVTVSSASTKG PSVFPLAPSSKSTSGGTAALGCLVKDYFPEPVTVSWNSGALTSG VHTFPAVLQSSGLYSLSSVVTVPSSSLGTQTYICNVNHKPSNTKV DKKVEPKSCDKTHTCPPCPAPELLGGPSVFLFPPKPKDTLMISRT PEVTCVVVDVSHEDPEVKFNWYVDGVEVHNAKTKPREEQYAS TYRVVSVLTVLHQDWLNGKEYKCKVSNKALPAPIEKTISKAKG QPREPQVYTLPPSRDELTKNQVSLTCLVKGFYPSDIAVEWESNG QPENNYKTTPPVLDSDGSFFLYSKLTVDKSRWQQGNVFSCSVM HEALHNHYTQKSLSLSPGK |
| 162 | ABP49 | Full Heavy, IgG1 N297A | QVQLQESGPGLVKPSQTLSLTCTVSGGSISSGGAVWSWIRQHPG KGLEWIGGIAYSGSTYYNPSLKSRVTISVDTSKNQFSLKLSSVTA ADTAVYYCARDSVRGYGDYGGHHAFDIWGQGTMVTVSSASTK GPSVFPLAPSSKSTSGGTAALGCLVKDYFPEPVTVSWNSGALTS GVHTFPAVLQSSGLYSLSSVVTVPSSSLGTQTYICNVNHKPSNTK VDKKVEPKSCDKTHTCPPCPAPELLGGPSVFLFPPKPKDTLMISR TPEVTCVVVDVSHEDPEVKFNWYVDGVEVHNAKTKPREEQYA STYRVVSVLTVLHQDWLNGKEYKCKVSNKALPAPIEKTISKAK GQPREPQVYTLPPSRDELTKNQVSLTCLVKGFYPSDIAVEWESN GQPENNYKTTPPVLDSDGSFFLYSKLTVDKSRWQQGNVFSCSV MHEALHNHYTQKSLSLSPGK |
| 163 | ABP50 | Full Heavy, N terminal Fab TM (IgG1 Fab, IgG4 S228P) | QVQLVQSGAEVKRPGSSVKVSCKASGGTFSSYYISWVRQVPGQ GLEWMGGIIPVPGTANYAQKFQGRVTITADESTSTAYMELSSLR SEDTAVYYCARAGGGYARGDHYYGMDVWGQGTTVTVSSAST KGPSVFPLAPSSKSTSGGTAALGCLVKDYFPEPVTVSWNSGALT SGVHTFPAVLQSSGLYSLSSVVTVPSSSLGTQTYICNVNHKPSNT KVDKRVEPKSCGGGGSQVQLVQSGAEVKRPGSSVKVSCKASG GTFSSYYISWVRQVPGQGLEWMGGIIPVPGTANYAQKFQGRVTI TADESTSTAYMELSSLRSEDTAVYYCARAGGGYARGDHYYGM DVWGQGTTVTVSSASTKGPSVFPLAPCSRSTSESTAALGCLVKD YFPEPVTVSWNSGALTSGVHTFPAVLQSSGLYSLSSVVTVPSSSL GTKTYTCNVDHKPSNTKVDKRVESKYGPPCPPCPAPEFLGGPSV FLFPPKPKDTLMISRTPEVTCVVVDVSQEDPEVQFNWYVDGVE VHNAKTKPREEQFNSTYRVVSVLTVLHQDWLNGKEYKCKVSN KGLPSSIEKTISKAKGQPREPQVYTLPPSQEEMTKNQVSLTCLVK GFYPSDIAVEWESNGQPENNYKTTPPVLDSDGSFFLYSRLTVDK SRWQEGNVFSCSVMHEALHNHYTQKSLSLSLGK |
| 164 | ABP51 | Full Heavy, N terminal Fab TM (IgG1 Fab, IgG4 S228P) | QVQLVQSGAEVKKPGSSVKVSCKASGGTFSSYYISWVRQAPGQ RLEWMGGIIPVPGTANYAQKFQGRVTITADESTSTAYMELSSLR SEDTAVYYCARAGGGYARGDHYYGMDVWGQGTTVTVSSAST KGPSVFPLAPSSKSTSGGTAALGCLVKDYFPEPVTVSWNSGALT SGVHTFPAVLQSSGLYSLSSVVTVPSSSLGTQTYICNVNHKPSNT KVDKRVEPKSCGGGGSQVQLVQSGAEVKKPGSSVKVSCKASG |

APPENDIX A-continued

SEQUENCES

| SEQ ID NO | Molecule | Description | SEQUENCE |
|---|---|---|---|
| | | | GTFSSYYISWVRQAPGQRLEWMGGIIPVPGTANYAQKFQGRVTI TADESTSTAYMELSSLRSEDTAVYYCARAGGGYARGDHYYGM DVWGQGTTVTVSSASTKGPSVFPLAPCSRSTSESTAALGCLVKD YFPEPVTVSWNSGALTSGVHTFPAVLQSSGLYSLSSVVTVPSSSL GTKTYTCNVDHKPSNTKVDKRVESKYGPPCPPCPAPEFLGGPSV FLFPPKPKDTLMISRTPEVTCVVVDVSQEDPEVQFNWYVDGVE VHNAKTKPREEQFNSTYRVVSVLTVLHQDWLNGKEYKCKVSN KGLPSSIEKTISKAKGQPREPQVYTLPPSQEEMTKNQVSLTCLVK GFYPSDIAVEWESNGQPENNYKTTPPVLDSDGSFFLYSRLTVDK SRWQEGNVFSCSVMHEALHNHYTQKSLSLSLGK |
| 165 | ABP52 | Full Heavy, N terminal Fab TM (IgG1 Fab, IgG4 S228P) | QVQLVQSGAEVKKPGSSVKVSCKASGGTFSRGAISWVRQAPGQ GLEWMGGIIPIEGTAYYAQKFQGRVTITADESTGTAYMELSSLR SEDTAVYYCARQSDYGLPRGMDVWGQGTTVTVSSASTKGPSV FPLAPSSKSTSGGTAALGCLVKDYFPEPVTVSWNSGALTSGVHT FPAVLQSSGLYSLSSVVTVPSSSLGTQTYICNVNHKPSNTKVDKR VEPKSCGGGGSQVQLVQSGAEVKKPGSSVKVSCKASGGTFSRG AISWVRQAPGQGLEWMGGIIPIEGTAYYAQKFQGRVTITADEST GTAYMELSSLRSEDTAVYYCARQSDYGLPRGMDVWGQGTTVT VSSASTKGPSVFPLAPCSRSTSESTAALGCLVKDYFPEPVTVSWN SGALTSGVHTFPAVLQSSGLYSLSSVVTVPSSSLGTKTYTCNVD HKPSNTKVDKRVESKYGPPCPPCPAPEFLGGPSVFLFPPKPKDTL MISRTPEVTCVVVDVSQEDPEVQFNWYVDGVEVHNAKTKPREE QFNSTYRVVSVLTVLHQDWLNGKEYKCKVSNKGLPSSIEKTISK AKGQPREPQVYTLPPSQEEMTKNQVSLTCLVKGFYPSDIAVEWE SNGQPENNYKTTPPVLDSDGSFFLYSRLTVDKSRWQEGNVFSCS VMHEALHNHYTQKSLSLSLGK |
| 166 | ABP53 | Full Heavy, N terminal Fab TM (IgG1 Fab, IgG4 S228P) | QVQLVQSGAEVKKPGSSVKVSCKASGGTFSSYAISWVRQAPGQ GLEWMGGIIPISGFTNYAQKFQGRVTITADESTSTAYMELSSLRS EDTAVYYCAREGGHYYSGWPYWGQGTLVTVSSASTKGPSVFP LAPSSKSTSGGTAALGCLVKDYFPEPVTVSWNSGALTSGVHTFP AVLQSSGLYSLSSVVTVPSSSLGTQTYICNVNHKPSNTKVDKRV EPKSCGGGGSQVQLVQSGAEVKKPGSSVKVSCKASGGTFSSYAI SWVRQAPGQGLEWMGGIIPISGFTNYAQKFQGRVTITADESTST AYMELSSLRSEDTAVYYCAREGGHYYSGWPYWGQGTLVTVSS ASTKGPSVFPLAPCSRSTSESTAALGCLVKDYFPEPVTVSWNSG ALTSGVHTFPAVLQSSGLYSLSSVVTVPSSSLGTKTYTCNVDHK PSNTKVDKRVESKYGPPCPPCPAPEFLGGPSVFLFPPKPKDTLMI SRTPEVTCVVVDVSQEDPEVQFNWYVDGVEVHNAKTKPREEQF NSTYRVVSVLTVLHQDWLNGKEYKCKVSNKGLPSSIEKTISKAK GQPREPQVYTLPPSQEEMTKNQVSLTCLVKGFYPSDIAVEWESN GQPENNYKTTPPVLDSDGSFFLYSRLTVDKSRWQEGNVFSCSV MHEALHNHYTQKSLSLSLGK |
| 167 | ABP54 | Full Heavy, N terminal Fab TM (IgG1 Fab, IgG4 S228P) | QVQLVQSGAEVKKPGSSVKVSCKASGGTFSSYAISWVRQAPGQ RLEWMGGIIPISGFTNYAQKFQGRVTITADESTSTAYMELSSLRS EDTAVYYCAREGGHYYSGWPYWGQGTLVTVSSASTKGPSVFP LAPSSKSTSGGTAALGCLVKDYFPEPVTVSWNSGALTSGVHTFP AVLQSSGLYSLSSVVTVPSSSLGTQTYICNVNHKPSNTKVDKRV EPKSCGGGGSQVQLVQSGAEVKKPGSSVKVSCKASGGTFSSYAI SWVRQAPGQRLEWMGGIIPISGFTNYAQKFQGRVTITADESTST AYMELSSLRSEDTAVYYCAREGGHYYSGWPYWGQGTLVTVSS ASTKGPSVFPLAPCSRSTSESTAALGCLVKDYFPEPVTVSWNSG ALTSGVHTFPAVLQSSGLYSLSSVVTVPSSSLGTKTYTCNVDHK PSNTKVDKRVESKYGPPCPPCPAPEFLGGPSVFLFPPKPKDTLMI SRTPEVTCVVVDVSQEDPEVQFNWYVDGVEVHNAKTKPREEQF NSTYRVVSVLTVLHQDWLNGKEYKCKVSNKGLPSSIEKTISKAK GQPREPQVYTLPPSQEEMTKNQVSLTCLVKGFYPSDIAVEWESN GQPENNYKTTPPVLDSDGSFFLYSRLTVDKSRWQEGNVFSCSV MHEALHNHYTQKSLSLSLGK |
| 168 | ABP55 | Full Heavy, N terminal Fab TM (IgG1 Fab, IgG4 S228P) | QVQLVQSGAEVKKPGSSVKVSCKASGGTFSSYAISWVRQAPGQ GLEWMGGIIPISGFTNYAQKFQGKVTITADESTSTAYMELSSLRS EDTAVYYCAREGGHYYSGWPYWGQGTLVTVSSASTKGPSVFP LAPSSKSTSGGTAALGCLVKDYFPEPVTVSWNSGALTSGVHTFP AVLQSSGLYSLSSVVTVPSSSLGTQTYICNVNHKPSNTKVDKRV EPKSCGGGGSQVQLVQSGAEVKKPGSSVKVSCKASGGTFSSYAI SWVRQAPGQGLEWMGGIIPISGFTNYAQKFQGKVTITADESTST AYMELSSLRSEDTAVYYCAREGGHYYSGWPYWGQGTLVTVSS ASTKGPSVFPLAPCSRSTSESTAALGCLVKDYFPEPVTVSWNSG ALTSGVHTFPAVLQSSGLYSLSSVVTVPSSSLGTKTYTCNVDHK PSNTKVDKRVESKYGPPCPPCPAPEFLGGPSVFLFPPKPKDTLMI SRTPEVTCVVVDVSQEDPEVQFNWYVDGVEVHNAKTKPREEQF |

APPENDIX A-continued

SEQUENCES

| SEQ ID NO | Molecule | Description | SEQUENCE |
|---|---|---|---|
| | | | NSTYRVVSVLTVLHQDWLNGKEYKCKVSNKGLPSSIEKTISKAK GQPREPQVYTLPPSQEEMTKNQVSLTCLVKGFYPSDIAVEWESN GQPENNYKTTPPVLDSDGSFFLYSRLTVDKSRWQEGNVFSCSV MHEALHNHYTQKSLSLSLGK |
| 169 | ABP56 | Full Heavy, N terminal Fab TM (IgG1 Fab, IgG4 S228P) | QVQLVQSGAEVKKPGSSVKVSCKASGGTFVRYAISWVRQAPGQ GLEWMGGIIPIFGEAQYAQRFQGRVTITADESTSTAYMELSSLRS EDTAVYYCAREGYYYGALPYWGQGTLVTVSSASTKGPSVFPLA PSSKSTSGGTAALGCLVKDYFPEPVTVSWNSGALTSGVHTFPAV LQSSGLYSLSSVVTVPSSSLGTQTYICNVNHKPSNTKVDKRVEP KSCGGGGSQVQLVQSGAEVKKPGSSVKVSCKASGGTFVRYAIS WVRQAPGQGLEWMGGIIPIFGEAQYAQRFQGRVTITADESTSTA YMELSSLRSEDTAVYYCAREGYYYGALPYWGQGTLVTVSSAST KGPSVFPLAPCSRSTSESTAALGCLVKDYFPEPVTVSWNSGALTS GVHTFPAVLQSSGLYSLSSVVTVPSSSLGTKTYTCNVDHKPSNT KVDKRVESKYGPPCPPCPAPEFLGGPSVFLFPPKPKDTLMISRTP EVTCVVVDVSQEDPEVQFNWYVDGVEVHNAKTKPREEQFNST YRVVSVLTVLHQDWLNGKEYKCKVSNKGLPSSIEKTISKAKGQ PREPQVYTLPPSQEEMTKNQVSLTCLVKGFYPSDIAVEWESNGQ PENNYKTTPPVLDSDGSFFLYSRLTVDKSRWQEGNVFSCSVMH EALHNHYTQKSLSLSLGK |
| 170 | ABP57 | Full Heavy, N terminal Fab TM (IgG1 Fab, IgG4 S228P) | QVQLVQSGAEVKKPGSSVKVSCKASGGTFVRYAISWVRQAPGQ GLEWMGGIIPIFGEAQYAQKFRGRATITADESTSTAYMELSSLRS EDTAVYYCAREGYYYGALPYWGQGTLVTVSSASTKGPSVFPLA PSSKSTSGGTAALGCLVKDYFPEPVTVSWNSGALTSGVHTFPAV LQSSGLYSLSSVVTVPSSSLGTQTYICNVNHKPSNTKVDKRVEP KSCGGGGSQVQLVQSGAEVKKPGSSVKVSCKASGGTFVRYAIS WVRQAPGQGLEWMGGIIPIFGEAQYAQKFRGRATITADESTSTA YMELSSLRSEDTAVYYCAREGYYYGALPYWGQGTLVTVSSAST KGPSVFPLAPCSRSTSESTAALGCLVKDYFPEPVTVSWNSGALTS GVHTFPAVLQSSGLYSLSSVVTVPSSSLGTKTYTCNVDHKPSNT KVDKRVESKYGPPCPPCPAPEFLGGPSVFLFPPKPKDTLMISRTP EVTCVVVDVSQEDPEVQFNWYVDGVEVHNAKTKPREEQFNST YRVVSVLTVLHQDWLNGKEYKCKVSNKGLPSSIEKTISKAKGQ PREPQVYTLPPSQEEMTKNQVSLTCLVKGFYPSDIAVEWESNGQ PENNYKTTPPVLDSDGSFFLYSRLTVDKSRWQEGNVFSCSVMH EALHNHYTQKSLSLSLGK |
| 179 | ABP58 | Full Heavy, IgG1 N297A | QVQLVQSGAEVKKPGASVKVSCKASGYTFTSYYMHWVRQAPG QGLEWMGIINPSGGSTTYAQKFQGRVTMTRDTSTSTVYMELSSL RSEDTAVYYCARGQYGYYGGRLDVWGQGTTVTVSSASTKGPS VFPLAPSSKSTSGGTAALGCLVKDYFPEPVTVSWNSGALTSGVH TFPAVLQSSGLYSLSSVVTVPSSSLGTQTYICNVNHKPSNTKVDK KVEPKSCDKTHTCPPCPAPELLGGPSVFLFPPKPKDTLMISRTPE VTCVVVDVSHEDPEVKFNWYVDGVEVHNAKTKPREEQYASTY RVVSVLTVLHQDWLNGKEYKCKVSNKALPAPIEKTISKAKGQP REPQVYTLPPSRDELTKNQVSLTCLVKGFYPSDIAVEWESNGQP ENNYKTTPPVLDSDGSFFLYSKLTVDKSRWQQGNVFSCSVMHE ALHNHYTQKSLSLSPGK |
| 180 | ABP59 | Full Heavy, IgG4 S228P | QVQLVQSGAEVKKPGASVKVSCKASGYTFTSYYMHWVRQAPG QGLEWMGIINPSGGSTTYAQKFQGRVTMTRDTSTSTVYMELSSL RSEDTAVYYCARGQYGYYGGRLDVVVGQGTTVTVSSASTKGPS VFPLAPCSRSTSESTAALGCLVKDYFPEPVTVSWNSGALTSGVH TFPAVLQSSGLYSLSSVVTVPSSSLGTKTYTCNVDHKPSNTKVD KRVESKYGPPCPPCPAPEFLGGPSVFLFPPKPKDTLMISRTPEVTC VVVDVSQEDPEVQFNWYVDGVEVHNAKTKPREEQFNSTYRVV SVLTVLHQDWLNGKEYKCKVSNKGLPSSIEKTISKAKGQPREPQ VYTLPPSQEEMTKNQVSLTCLVKGFYPSDIAVEWESNGQPENN YKTTPPVLDSDGSFFLYSRLTVDKSRWQEGNVFSCSVMHEALH NHYTQKSLSLSLGK |
| 181 | ABP60 | Full Heavy, IgG1 N297A | QVQLVESGGGVVQPGRSLRLSCAASGFTFSSYGMHWVRQAPG KGLEWVAVISYDGSNKYYADSVKGRFTISRDNSKNTLYLQMNS LRAEDTAVYYCARDGLGYMAWGQGTTVTVSSASTKGPSVFPL APSSKSTSGGTAALGCLVKDYFPEPVTVSWNSGALTSGVHTFPA VLQSSGLYSLSSVVTVPSSSLGTQTYICNVNHKPSNTKVDKKVE PKSCDKTHTCPPCPAPELLGGPSVFLFPPKPKDTLMISRTPEVTC VVVDVSHEDPEVKFNWYVDGVEVHNAKTKPREEQYASTYRVV SVLTVLHQDWLNGKEYKCKVSNKALPAPIEKTISKAKGQPREPQ VYTLPPSRDELTKNQVSLTCLVKGFYPSDIAVEWESNGQPENNY KTTPPVLDSDGSFFLYSKLTVDKSRWQQGNVFSCSVMHEALHN HYTQKSLSLSPGK |

APPENDIX A-continued

SEQUENCES

| SEQ ID NO | Molecule | Description | SEQUENCE |
|---|---|---|---|
| 182 | ABP61 | Full Heavy, IgG4 S228P | QVQLVESGGGVVQPGRSLRLSCAASGFTFSSYGMHWVRQAPG KGLEWVAVISYDGSNKYYADSVKGRFTISRDNSKNTLYLQMNS LRAEDTAVYYCARDGLGYMAWGQGTTVTVSSASTKGPSVFPL APCSRSTSESTAALGCLVKDYFPEPVTVSWNSGALTSGVHTFPA VLQSSGLYSLSSVVTVPSSSLGTKTYTCNVDHKPSNTKVDKRVE SKYGPPCPPCPAPEFLGGPSVFLFPPKPKDTLMISRTPEVTCVVV DVSQEDPEVQFNWYVDGVEVHNAKTKPREEQFNSTYRVVSVL TVLHQDWLNGKEYKCKVSNKGLPSSIEKTISKAKGQPREPQVYT LPPSQEEMTKNQVSLTCLVKGFYPSDIAVEWESNGQPENNYKTT PPVLDSDGSFFLYSRLTVDKSRWQEGNVFSCSVMHEALHNHYT QKSLSLSLGK |
| 183 | ABP62 | Full Heavy, N terminal Fab TM (IgG1 Fab, IgG1 (G1m(3))) | QVQLQESGPGLVKPSETLSLTCAVSGYSISSGLGWGWIRQPPGK GLEWIGGIYESGSTYYNPSLKSRVTISVDTSKNQFSLKLSSVTAA DTAVYYCAHERVRGYGDYGGHHAFDIWGQGTMVTVSSASTKG PSVFPLAPSSKSTSGGTAALGCLVKDYFPEPVTVSWNSGALTSG VHTFPAVLQSSGLYSLSSVVTVPSSSLGTQTYICNVNHKPSNTKV DKRVEPKSCGGGGSQVQLQESGPGLVKPSETLSLTCAVSGYSISS GLGWGWIRQPPGKGLEWIGGIYESGSTYYNPSLKSRVTISVDTS KNQFSLKLSSVTAADTAVYYCAHERVRGYGDYGGHHAFDIWG QGTMVTVSSASTKGPSVFPLAPSSKSTSGGTAALGCLVKDYFPE PVTVSWNSGALTSGVHTFPAVLQSSGLYSLSSVVTVPSSSLGTQ TYICNVNHKPSNTKVDKRVEPKSCDKTHTCPPCPAPELLGGPSV FLFPPKPKDTLMISRTPEVTCVVVDVSHEDPEVKFNWYVDGVE VHNAKTKPREEQYNSTYRVVSVLTVLHQDWLNGKEYKCKVSN KALPAPIEKTISKAKGQPREPQVYTLPPSREEMTKNQVSLTCLVK GFYPSDIAVEWESNGQPENNYKTTPPVLDSDGSFFLYSKLTVDK SRWQQGNVFSCSVMHEALHNHYTQKSLSLSPGK |
| 184 | ABP63 | Full Heavy, N terminal Fab TM (IgG1 Fab, IgG1 (G1m(3))) | QVQLQESGPGLVKPSQTLSLTCTVSGGSISSGGAVWSWIRQHPG KGLEWIGGIAYSGSTYYNPSLKSRVTISVDTSKNQFSLKLSSVTA ADTAVYYCADENVRGYGDYGGHHAFDIWGQGTMVTVSSAST KGPSVFPLAPSS KSTSGGTAALGCLVKDYFPEPVTVSWNSGALTSGVHTFPAVLQ SSGLYSLSSVVTVPSSSLGTQTYICNVNHKPSNTKVDKRVEPKSC GGGGSQVQLQESGPGLVKPSQTLSLTCTVSGGSISSGGAVWSWI RQHPGKGLEWIGGIAYSGSTYYNPSLKSRVTISVDTSKNQFSLKL SSVTAADTAVYYCADENVRGYGDYGGHHAFDIWGQGTMVTV SSASTKGPSVFPLAPSSKSTSGGTAALGCLVKDYFPEPVTVSWNS GALTSGVHTFPAVLQSSGLYSLSSVVTVPSSSLGTQTYICNVNHK PSNTKVDKRVEPKSCDKTHTCPPCPAPELLGGPSVFLFPPKPKDT LMISRTPEVTCVVVDVSHEDPEVKFNWYVDGVEVHNAKTKPRE EQYNSTYRVVSVLTVLHQDWLNGKEYKCKVSNKALPAPIEKTI SKAKGQPREPQVYTLPPSREEMTKNQVSLTCLVKGFYPSDIAVE WESNGQPENNYKTTPPVLDSDGSFFLYSKLTVDKSRWQQGNVF SCSVMHEALHNHYTQKSLSLSPGK |
| 185 | ABP64 | Full Heavy, N terminal Fab TM (IgG1 Fab, IgG1 (G1m(3))) | QVQLQESGPGLVKPSETLSLTCAVSGYSISSGAGWGWIRQPPGK GLEWIGLIVHSGSTYYNPSLKSRVTISVDTSKNQFSLKLSSVTAA DTAVYYCVLESVRGYGDYGGHHAFDIWGQGTMVTVSSASTKG PSVFPLAPSSKSTSGGTAALGCLVKDYFPEPVTVSWNSGALTSG VHTFPAVLQSSGLYSLSSVVTVPSSSLGTQTYICNVNHKPSNTKV DKRVEPKSCGGGGSQVQLQESGPGLVKPSETLSLTCAVSGYSISS GAGWGWIRQPPGKGLEWIGLIVHSGSTYYNPSLKSRVTISVDTS KNQFSLKLSSVTAADTAVYYCVLESVRGYGDYGGHHAFDIWG QGTMVTVSSASTKGPSVFPLAPSSKSTSGGTAALGCLVKDYFPE PVTVSWNSGALTSGVHTFPAVLQSSGLYSLSSVVTVPSSSLGTQ TYICNVNHKPSNTKVDKRVEPKSCDKTHTCPPCPAPELLGGPSV FLFPPKPKDTLMISRTPEVTCVVVDVSHEDPEVKFNWYVDGVE VHNAKTKPREEQYNSTYRVVSVLTVLHQDWLNGKEYKCKVSN KALPAPIEKTISKAKGQPREPQVYTLPPSREEMTKNQVSLTCLVK GFYPSDIAVEWESNGQPENNYKTTPPVLDSDGSFFLYSKLTVDK SRWQQGNVFSCSVMHEALHNHYTQKSLSLSPGK |
| 186 | ABP65 | Full Heavy, N terminal Fab TM (IgG1 Fab, IgG1 (G1m(3))) | QVQLQESGPGLVKPSETLSLTCAVSGYSISSGAGWGWIRQPPGK GPEWIGLIVHSGSTYYNPSLKSRVTISVDTSKNQFSLKLSSVTAA DTAVYYCVLESVRGYGDYGGHHAFDIWGQGTMVTVSSASTKG PSVFPLAPSSKSTSGGTAALGCLVKDYFPEPVTVSWNSGALTSG VHTFPAVLQSSGLYSLSSVVTVPSSSLGTQTYICNVNHKPSNTKV DKRVEPKSCGGGGSQVQLQESGPGLVKPSETLSLTCAVSGYSISS GAGWGWIRQPPGKGPEWIGLIVHSGSTYYNPSLKSRVTISVDTS KNQFSLKLSSVTAADTAVYYCVLESVRGYGDYGGHHAFDIWG QGTMVTVSSASTKGPSVFPLAPSSKSTSGGTAALGCLVKDYFPE |

APPENDIX A-continued

SEQUENCES

| SEQ ID NO | Molecule | Description | SEQUENCE |
|---|---|---|---|
| | | | PVTVSWNSGALTSGVHTFPAVLQSSGLYSLSSVVTVPSSSLGTQ<br>TYICNVNHKPSNTKVDKRVEPKSCDKTHTCPPCPAPELLGGPSV<br>FLFPPKPKDTLMISRTPEVTCVVVDVSHEDPEVKFNWYVDGVE<br>VHNAKTKPREEQYNSTYRVVSVLTVLHQDWLNGKEYKCKVSN<br>KALPAPIEKTISKAKGQPREPQVYTLPPSREEMTKNQVSLTCLVK<br>GFYPSDIAVEWESNGQPENNYKTTPPVLDSDGSFFLYSKLTVDK<br>SRWQQGNVFSCSVMHEALHNHYTQKSLSLSPGK |
| 187 | ABP66 | Full Heavy, N terminal Fab TM (IgG1 Fab, IgG1 (G1m(3))) | QVQLQESGPGLVKPSETLSLTCAVSGYSISSGAGWGWIRQPPGK<br>GLEWIGLIVHSGSTYYNPSLKSRVTISVDTSKNQFSLKLSSVTAA<br>DTAVYYCVLESVRGYGDYGGHHAFDIWGQGTMVTVSSASTKG<br>PSVFPLAPSSKSTSGGTAALGCLVKDYFPEPVTVSWNSGALTSG<br>VHTFPAVLQSSGLYSLSSVVTVPSSSLGTQTYICNVNHKPSNTKV<br>DKRVEPKSCGGGGSQVQLQESGPGLVKPSETLSLTCAVSGYSISS<br>GAGWGWIRQPPGKGLEWIGLIVHSGSTYYNPSLKSRVTISVDTS<br>KNQFSLKLSSVTAADTAVYYCVLESVRGYGDYGGHHAFDIWG<br>QGTMVTVSSASTKGPSVFPLAPSSKSTSGGTAALGCLVKDYFPE<br>PVTVSWNSGALTSGVHTFPAVLQSSGLYSLSSVVTVPSSSLGTQ<br>TYICNVNHKPSNTKVDKRVEPKSCDKTHTCPPCPAPELLGGPSV<br>FLFPPKPKDTLMISRTPEVTCVVVDVSHEDPEVKFNWYVDGVE<br>VHNAKTKPREEQYNSTYRVVSVLTVLHQDWLNGKEYKCKVSN<br>KALPAPIEKTISKAKGQPREPQVYTLPPSREEMTKNQVSLTCLVK<br>GFYPSDIAVEWESNGQPENNYKTTPPVLDSDGSFFLYSKLTVDK<br>SRWQQGNVFSCSVMHEALHNHYTQKSLSLSPGK |
| 188 | ABP67 | Full Heavy, N terminal Fab TM (IgG1 Fab, IgG1 (G1m(3))) | QVQLQESGPGLVKPSETLSLTCAVSGYSISSGAGWGWIRQPPGK<br>GLEWIGLIVHSGSTYYNPSLKSRVTISVDTSKNQFSLKLSSVTAA<br>DTAVYYCVLESVRGYGDYGGHHAFDIWGQGTMVTVSSASTKG<br>PSVFPLAPSSKSTSGGTAALGCLVKDYFPEPVTVSWNSGALTSG<br>VHTFPAVLQSSGLYSLSSVVTVPSSSLGTQTYICNVNHKPSNTKV<br>DKRVEPKSCGGGGSQVQLQESGPGLVKPSETLSLTCAVSGYSISS<br>GAGWGWIRQPPGKGLEWIGLIVHSGSTYYNPSLKSRVTISVDTS<br>KNQFSLKLSSVTAADTAVYYCVLESVRGYGDYGGHHAFDIWG<br>QGTMVTVSSASTKGPSVFPLAPSSKSTSGGTAALGCLVKDYFPE<br>PVTVSWNSGALTSGVHTFPAVLQSSGLYSLSSVVTVPSSSLGTQ<br>TYICNVNHKPSNTKVDKRVEPKSCDKTHTCPPCPAPELLGGPSV<br>FLFPPKPKDTLMISRTPEVTCVVVDVSHEDPEVKFNWYVDGVE<br>VHNAKTKPREEQYNSTYRVVSVLTVLHQDWLNGKEYKCKVSN<br>KALPAPIEKTISKAKGQPREPQVYTLPPSREEMTKNQVSLTCLVK<br>GFYPSDIAVEWESNGQPENNYKTTPPVLDSDGSFFLYSKLTVDK<br>SRWQQGNVFSCSVMHEALHNHYTQKSLSLSPGK |
| 189 | ABP68 | Full Heavy, N terminal Fab TM (IgG1 Fab, IgG1 (G1m(3))) | QVQLQESGPGLVKPSETLSLTCAVSGYSISSEYMWGWIRQPPGK<br>GLEWIGLIYHSGKTYYNPSLKSRVTISVDTSKNQFSLKLSSVTAA<br>DTAVYYCAREADRGYGDYGGHHAFDIWGQGTMVTVSSASTKG<br>PSVFPLAPSSKSTSGGTAALGCLVKDYFPEPVTVSWNSGALTSG<br>VHTFPAVLQSSGLYSLSSVVTVPSSSLGTQTYICNVNHKPSNTKV<br>DKRVEPKSCGGGGSQVQLQESGPGLVKPSETLSLTCAVSGYSISS<br>EYMWGWIRQPPGKGLEWIGLIYHSGKTYYNPSLKSRVTISVDTS<br>KNQFSLKLSSVTAADTAVYYCAREADRGYGDYGGHHAFDIWG<br>QGTMVTVSSASTKGPSVFPLAPSSKSTSGGTAALGCLVKDYFPE<br>PVTVSWNSGALTSGVHTFPAVLQSSGLYSLSSVVTVPSSSLGTQ<br>TYICNVNHKPSNTKVDKRVEPKSCDKTHTCPPCPAPELLGGPSV<br>FLFPPKPKDTLMISRTPEVTCVVVDVSHEDPEVKFNWYVDGVE<br>VHNAKTKPREEQYNSTYRVVSVLTVLHQDWLNGKEYKCKVSN<br>KALPAPIEKTISKAKGQPREPQVYTLPPSREEMTKNQVSLTCLVK<br>GFYPSDIAVEWESNGQPENNYKTTPPVLDSDGSFFLYSKLTVDK<br>SRWQQGNVFSCSVMHEALHNHYTQKSLSLSPGK |
| 190 | ABP69 | Full Heavy, N terminal Fab TM (IgG1 Fab, IgG1 (G1m(3))) | QVQLQESGPGLVKPSETLSLTCAVSGYSISSEYMWGWIRQPPGK<br>GLEWIGLIYHSGKTYYNPSLKSRVTISVDTSKNQFSLKLSSVTAA<br>DTAVYYCAREADRGYGDYGGHHAFDIWGQGTMVTVSSASTKG<br>PSVFPLAPSSKSTSGGTAALGCLVKDYFPEPVTVSWNSGALTSG<br>VHTFPAVLQSSGLYSLSSVVTVPSSSLGTQTYICNVNHKPSNTKV<br>DKRVEPKSCGGGGSQVQLQESGPGLVKPSETLSLTCAVSGYSISS<br>EYMWGWIRQPPGKGLEWIGLIYHSGKTYYNPSLKSRVTISVDTS<br>KNQFSLKLSSVTAADTAVYYCAREADRGYGDYGGHHAFDIWG<br>QGTMVTVSSASTKGPSVFPLAPSSKSTSGGTAALGCLVKDYFPE<br>PVTVSWNSGALTSGVHTFPAVLQSSGLYSLSSVVTVPSSSLGTQ<br>TYICNVNHKPSNTKVDKRVEPKSCDKTHTCPPCPAPELLGGPSV<br>FLFPPKPKDTLMISRTPEVTCVVVDVSHEDPEVKFNWYVDGVE<br>VHNAKTKPREEQYNSTYRVVSVLTVLHQDWLNGKEYKCKVSN |

APPENDIX A-continued

SEQUENCES

| SEQ ID NO | Molecule | Description | SEQUENCE |
|---|---|---|---|
| | | | KALPAPIEKTISKAKGQPREPQVYTLPPSREEMTKNQVSLTCLVK GFYPSDIAVEWESNGQPENNYKTTPPVLDSDGSFFLYSKLTVDK SRWQQGNVFSCSVMHEALHNHYTQKSLSLSPGK |
| 191 | ABP70 | Full Heavy, C terminal Fab TM, linker = 5 mer (IgG1 (G1m(3)), IgG1 Fab) | QVQLQESGPGLVKPSETLSLTCAVSGYSISSGLGWGWIRQPPGK GLEWIGGIYESGSTYYNPSLKSRVTISVDTSKNQFSLKLSSVTAA DTAVYYCAHERVRGYGDYGGHHAFDIWGQGTMVTVSSASTKG PSVFPLAPSSKSTSGGTAALGCLVKDYFPEPVTVSWNSGALTSG VHTFPAVLQSSGLYSLSSVVTVPSSSLGTQTYICNVNHKPSNTKV DKRVEPKSCDKTHTCPPCPAPELLGGPSVFLFPPKPKDTLMISRT PEVTCVVVDVSHEDPEVKFNWYVDGVEVHNAKTKPREEQYNS TYRVVSVLTVLHQDWLNGKEYKCKVSNKALPAPIEKTISKAKG QPREPQVYTLPPSREEMTKNQVSLTCLVKGFYPSDIAVEWESNG QPENNYKTTPPVLDSDGSFFLYSKLTVDKSRWQQGNVFSCSVM HEALHNHYTQKSLSLSPGKGGGGSQVQLQESGPGLVKPSETLSL TCAVSGYSISSGLGWGWIRQPPGKGLEWIGGIYESGSTYYNPSL KSRVTISVDTSKNQFSLKLSSVTAADTAVYYCAHERVRGYGDY GGHHAFDIWGQGTMVTVSSASTKGPSVFPLAPSSKSTSGGTAAL GCLVKDYFPEPVTVSWNSGALTSGVHTFPAVLQSSGLYSLSSVV TVPSSSLGTQTYICNVNHKPSNTKVDKRVEPKSC |
| 192 | ABP71 | Full Heavy, C terminal Fab TM, linker = 5 mer (IgG1 (G1m(3)), IgG1 Fab) | QVQLQESGPGLVKPSQTLSLTCTVSGGSISSGGAVWSWIRQHPG KGLEWIGGIAYSGSTYYNPSLKSRVTISVDTSKNQFSLKLSSVTA ADTAVYYCADENVRGYGDYGGHHAFDIWGQGTMVTVSSAST KGPSVFPLAPSSKSTSGGTAALGCLVKDYFPEPVTVSWNSGALT SGVHTFPAVLQSSGLYSLSSVVTVPSSSLGTQTYICNVNHKPSNT KVDKRVEPKSCDKTHTCPPCPAPELLGGPSVFLFPPKPKDTLMIS RTPEVTCVVVDVSHEDPEVKFNWYVDGVEVHNAKTKPREEQY NSTYRVVSVLTVLHQDWLNGKEYKCKVSNKALPAPIEKTISKA KGQPREPQVYTLPPSREEMTKNQVSLTCLVKGFYPSDIAVEWES NGQPENNYKTTPPVLDSDGSFFLYSKLTVDKSRWQQGNVFSCS VMHEALHNHYTQKSLSLSPGKGGGGSQVQLQESGPGLVKPSQT LSLTCTVSGGSISSGGAVWSWIRQHPGKGLEWIGGIAYSGSTYY NPSLKSRVTISVDTSKNQFSLKLSSVTAADTAVYYCADENVRGY GDYGGHHAFDIWGQGTMVTVSSASTKGPSVFPLAPSSKSTSGGT AALGCLVKDYFPEPVTVSWNSGALTSGVHTFPAVLQSSGLYSLS SVVTVPSSSLGTQTYICNVNHKPSNTKVDKRVEPKSC |
| 193 | ABP72 | Full Heavy, C terminal Fab TM, linker = 5 mer (IgG1 (G1m(3)), IgG1 Fab) | QVQLQESGPGLVKPSETLSLTCAVSGYSISSGAGWGWIRQPPGK GLEWIGLIVHSGSTYYNPSLKSRVTISVDTSKNQFSLKLSSVTAA DTAVYYCVLESVRGYGDYGGHHAFDIWGQGTMVTVSSASTKG PSVFPLAPSSKSTSGGTAALGCLVKDYFPEPVTVSWNSGALTSG VHTFPAVLQSSGLYSLSSVVTVPSSSLGTQTYICNVNHKPSNTKV DKRVEPKSCDKTHTCPPCPAPELLGGPSVFLFPPKPKDTLMISRT PEVTCVVVDVSHEDPEVKFNWYVDGVEVHNAKTKPREEQYNS TYRVVSVLTVLHQDWLNGKEYKCKVSNKALPAPIEKTISKAKG QPREPQVYTLPPSREEMTKNQVSLTCLVKGFYPSDIAVEWESNG QPENNYKTTPPVLDSDGSFFLYSKLTVDKSRWQQGNVFSCSVM HEALHNHYTQKSLSLSPGKGGGGSQVQLQESGPGLVKPSETLSL TCAVSGYSISSGAGWGWIRQPPGKGLEWIGLIVHSGSTYYNPSL KSRVTISVDTSKNQFSLKLSSVTAADTAVYYCVLESVRGYGDY GGHHAFDIWGQGTMVTVSSASTKGPSVFPLAPSSKSTSGGTAAL GCLVKDYFPEPVTVSWNSGALTSGVHTFPAVLQSSGLYSLSSVV TVPSSSLGTQTYICNVNHKPSNTKVDKRVEPKSC |
| 194 | ABP73 | Full Heavy, C terminal Fab TM, linker = 5 mer (IgG1 (G1m(3)), IgG1 Fab) | QVQLQESGPGLVKPSETLSLTCAVSGYSISSGAGWGWIRQPPGK GPEWIGLIVHSGSTYYNPSLKSRVTISVDTSKNQFSLKLSSVTAA DTAVYYCVLESVRGYGDYGGHHAFDIWGQGTMVTVSSASTKG PSVFPLAPSSKSTSGGTAALGCLVKDYFPEPVTVSWNSGALTSG VHTFPAVLQSSGLYSLSSVVTVPSSSLGTQTYICNVNHKPSNTKV DKRVEPKSCDKTHTCPPCPAPELLGGPSVFLFPPKPKDTLMISRT PEVTCVVVDVSHEDPEVKFNWYVDGVEVHNAKTKPREEQYNS TYRVVSVLTVLHQDWLNGKEYKCKVSNKALPAPIEKTISKAKG QPREPQVYTLPPSREEMTKNQVSLTCLVKGFYPSDIAVEWESNG QPENNYKTTPPVLDSDGSFFLYSKLTVDKSRWQQGNVFSCSVM HEALHNHYTQKSLSLSPGKGGGGSQVQLQESGPGLVKPSETLSL TCAVSGYSISSGAGWGWIRQPPGKGPEWIGLIVHSGSTYYNPSL KSRVTISVDTSKNQFSLKLSSVTAADTAVYYCVLESVRGYGDY GGHHAFDIWGQGTMVTVSSASTKGPSVFPLAPSSKSTSGGTAAL GCLVKDYFPEPVTVSWNSGALTSGVHTFPAVLQSSGLYSLSSVV TVPSSSLGTQTYICNVNHKPSNTKVDKRVEPKSC |
| 195 | ABP74 | Full Heavy, C terminal Fab | QVQLQESGPGLVKPSETLSLTCAVSGYSISSGAGWGWIRQPPGK GLEWIGLIVHSGSTYYNPSLKSRVTISVDTSKNQFSLKLSSVTAA |

APPENDIX A-continued

SEQUENCES

| SEQ ID NO | Molecule | Description | SEQUENCE |
|---|---|---|---|
| | | TM, linker = 5 mer (IgG1 (G1m(3)), IgG1 Fab) | DTAVYYCVLESVRGYGDYGGHHAFDIWGQGTMVTVSSASTKG PSVFPLAPSSKSTSGGTAALGCLVKDYFPEPVTVSWNSGALTSG VHTFPAVLQSSGLYSLSSVVTVPSSSLGTQTYICNVNHKPSNTKV DKRVEPKSCDKTHTCPPCPAPELLGGPSVFLFPPKPKDTLMISRT PEVTCVVVDVSHEDPEVKFNWYVDGVEVHNAKTKPREEQYNS TYRVVSVLTVLHQDWLNGKEYKCKVSNKALPAPIEKTISKAKG QPREPQVYTLPPSREEMTKNQVSLTCLVKGFYPSDIAVEWESNG QPENNYKTTPPVLDSDGSFFLYSKLTVDKSRWQQGNVFSCSVM HEALHNHYTQKSLSLSPGKGGGGSQVQLQESGPGLVKPSETLSL TCAVSGYSISSGAGWGWIRQPPGKGLEWIGLIVHSGSTYYNPSL KSRVTISVDTSKNQFSLKLSSVTAADTAVYYCVLESVRGYGDY GGHHAFDIWGQGTMVTVSSASTKGPSVFPLAPSSKSTSGGTAAL GCLVKDYFPEPVTVSWNSGALTSGVHTFPAVLQSSGLYSLSSVV TVPSSSLGTQTYICNVNHKPSNTKVDKRVEPKSC |
| 196 | ABP75 | Full Heavy, C terminal Fab TM, linker = 5 mer (IgG1 (G1m(3)), IgG1 Fab) | QVQLQESGPGLVKPSETLSLTCAVSGYSISSGAGWGWIRQPPGK GLEWIGLIVHSGSTYYNPSLKSRVTISVDTSKNQFSLKLSSVTAA DTAVYYCVLESVRGYGDYGGHHAFDIWGQGTMVTVSSASTKG PSVFPLAPSSKSTSGGTAALGCLVKDYFPEPVTVSWNSGALTSG VHTFPAVLQSSGLYSLSSVVTVPSSSLGTQTYICNVNHKPSNTKV DKRVEPKSCDKTHTCPPCPAPELLGGPSVFLFPPKPKDTLMISRT PEVTCVVVDVSHEDPEVKFNWYVDGVEVHNAKTKPREEQYNS TYRVVSVLTVLHQDWLNGKEYKCKVSNKALPAPIEKTISKAKG QPREPQVYTLPPSREEMTKNQVSLTCLVKGFYPSDIAVEWESNG QPENNYKTTPPVLDSDGSFFLYSKLTVDKSRWQQGNVFSCSVM HEALHNHYTQKSLSLSPGKGGGGSQVQLQESGPGLVKPSETLSL TCAVSGYSISSGAGWGWIRQPPGKGLEWIGLIVHSGSTYYNPSL KSRVTISVDTSKNQFSLKLSSVTAADTAVYYCVLESVRGYGDY GGHHAFDIWGQGTMVTVSSASTKGPSVFPLAPSSKSTSGGTAAL GCLVKDYFPEPVTVSWNSGALTSGVHTFPAVLQSSGLYSLSSVV TVPSSSLGTQTYICNVNHKPSNTKVDKRVEPKSC |
| 197 | ABP76 | Full Heavy, C terminal Fab TM, linker = 5 mer (IgG1 (G1m(3)), IgG1 Fab) | QVQLQESGPGLVKPSETLSLTCAVSGYSISSEYMWGWIRQPPGK GLEWIGLIYHSGKTYYNPSLKSRVTISVDTSKNQFSLKLSSVTAA DTAVYYCAREADRGYGDYGGHHAFDIWGQGTMVTVSSASTKG PSVFPLAPSSKSTSGGTAALGCLVKDYFPEPVTVSWNSGALTSG VHTFPAVLQSSGLYSLSSVVTVPSSSLGTQTYICNVNHKPSNTKV DKRVEPKSCDKTHTCPPCPAPELLGGPSVFLFPPKPKDTLMISRT PEVTCVVVDVSHEDPEVKFNWYVDGVEVHNAKTKPREEQYNS TYRVVSVLTVLHQDWLNGKEYKCKVSNKALPAPIEKTISKAKG QPREPQVYTLPPSREEMTKNQVSLTCLVKGFYPSDIAVEWESNG QPENNYKTTPPVLDSDGSFFLYSKLTVDKSRWQQGNVFSCSVM HEALHNHYTQKSLSLSPGKGGGGSQVQLQESGPGLVKPSETLSL TCAVSGYSISSEYMWGWIRQPPGKGLEWIGLIYHSGKTYYNPSL KSRVTISVDTSKNQFSLKLSSVTAADTAVYYCAREADRGYGDY GGHHAFDIWGQGTMVTVSSASTKGPSVFPLAPSSKSTSGGTAAL GCLVKDYFPEPVTVSWNSGALTSGVHTFPAVLQSSGLYSLSSVV TVPSSSLGTQTYICNVNHKPSNTKVDKRVEPKSC |
| 198 | ABP77 | Full Heavy, C terminal Fab TM, linker = 5 mer (IgG1 (G1m(3)), IgG1 Fab) | QVQLQESGPGLVKPSETLSLTCAVSGYSISSEYMWGWIRQPPGK GLEWIGLIYHSGKTYYNPSLKSRVTISVDTSKNQFSLKLSSVTAA DTAVYYCAREADRGYGDYGGHHAFDIWGQGTMVTVSSASTKG PSVFPLAPSSKSTSGGTAALGCLVKDYFPEPVTVSWNSGALTSG VHTFPAVLQSSGLYSLSSVVTVPSSSLGTQTYICNVNHKPSNTKV DKRVEPKSCDKTHTCPPCPAPELLGGPSVFLFPPKPKDTLMISRT PEVTCVVVDVSHEDPEVKFNWYVDGVEVHNAKTKPREEQYNS TYRVVSVLTVLHQDWLNGKEYKCKVSNKALPAPIEKTISKAKG QPREPQVYTLPPSREEMTKNQVSLTCLVKGFYPSDIAVEWESNG QPENNYKTTPPVLDSDGSFFLYSKLTVDKSRWQQGNVFSCSVM HEALHNHYTQKSLSLSPGKGGGGSQVQLQESGPGLVKPSETLSL TCAVSGYSISSEYMWGWIRQPPGKGLEWIGLIYHSGKTYYNPSL KSRVTISVDTSKNQFSLKLSSVTAADTAVYYCAREADRGYGDY GGHHAFDIWGQGTMVTVSSASTKGPSVFPLAPSSKSTSGGTAAL GCLVKDYFPEPVTVSWNSGALTSGVHTFPAVLQSSGLYSLSSVV TVPSSSLGTQTYICNVNHKPSNTKVDKRVEPKSC |
| 199 | ABP78 | Full Heavy, N terminal Fab TM (IgG1 Fab, IgG1 (G1m(3))) | QVQLVQSGAEVKRPGSSVKVSCKASGGTFSSYYISWVRQVPGQ GLEWMGGIIPVPGTANYAQKFQGRVTITADESTSTAYMELSSLR SEDTAVYYCARAGGGYARGDHYYGMDVWGQGTTVTVSSAST KGPSVFPLAPSSKSTSGGTAALGCLVKDYFPEPVTVSWNSGALT SGVHTFPAVLQSSGLYSLSSVVTVPSSSLGTQTYICNVNHKPSNT KVDKRVEPKSCGGGGSQVQLVQSGAEVKRPGSSVKVSCKASG GTFSSYYISWVRQVPGQGLEWMGGIIPVPGTANYAQKFQGRVTI TADESTSTAYMELSSLRSEDTAVYYCARAGGGYARGDHYYGM |

APPENDIX A-continued

SEQUENCES

| SEQ ID NO | Molecule | Description | SEQUENCE |
|---|---|---|---|
| | | | DVWGQGTTVTVSSASTKGPSVFPLAPSSKSTSGGTAALGCLVKD YPPEPVTVSWNSGALTSGVHTFPAVLQSSGLYSLSSVVTVPSSSL GTQTYICNVNHKPSNTKVDKRVEPKSCDKTHTCPPCPAPELLGG PSVFLFPPKPKDTLMISRTPEVTCVVVDVSHEDPEVKFNWYVDG VEVHNAKTKPREEQYNSTYRVVSVLTVLHQDWLNGKEYKCKV SNKALPAPIEKTISKAKGQPREPQVYTLPPSREEMTKNQVSLTCL VKGFYPSDIAVEWESNGQPENNYKTTPPVLDSDGSFFLYSKLTV DKSRWQQGNVFSCSVMHEALHNHYTQKSLSLSPGK |
| 200 | ABP79 | Full Heavy, N terminal Fab TM (IgG1 Fab, IgG1 (G1m(3))) | QVQLVQSGAEVKKPGSSVKVSCKASGGTFSSYYISWVRQAPGQ RLEWMGGIIPVPGTANYAQKFQGRVTITADESTSTAYMELSSLR SEDTAVYYCARAGGGYARGDHYYGMDVWGQGTTVTVSSAST KGPSVFPLAPSSKSTSGGTAALGCLVKDYFPEPVTVSWNSGALT SGVHTFPAVLQSSGLYSLSSVVTVPSSSLGTQTYICNVNHKPSNT KVDKRVEPKSCGGGGSQVQLVQSGAEVKKPGSSVKVSCKASG GTFSSYYISWVRQAPGQRLEWMGGIIPVPGTANYAQKFQGRVTI TADESTSTAYMELSSLRSEDTAVYYCARAGGGYARGDHYYGM DVWGQGTTVTVSSASTKGPSVFPLAPSSKSTSGGTAALGCLVKD YFPEPVTVSWNSGALTSGVHTFPAVLQSSGLYSLSSVVTVPSSSL GTQTYICNVNHKPSNTKVDKRVEPKSCDKTHTCPPCPAPELLGG PSVFLFPPKPKDTLMISRTPEVTCVVVDVSHEDPEVKFNWYVDG VEVHNAKTKPREEQYNSTYRVVSVLTVLHQDWLNGKEYKCKV SNKALPAPIEKTISKAKGQPREPQVYTLPPSREEMTKNQVSLTCL VKGFYPSDIAVEWESNGQPENNYKTTPPVLDSDGSFFLYSKLTV DKSRWQQGNVFSCSVMHEALHNHYTQKSLSLSPGK |
| 201 | ABP80 | Full Heavy, N terminal Fab TM (IgG1 Fab, IgG1 (G1m(3))) | QVQLVQSGAEVKKPGSSVKVSCKASGGTFSRGAISWVRQAPGQ GLEWMGGIIPIEGTAYYAQKFQGRVTITADESTGTAYMELSSLR SEDTAVYYCARQSDYGLPRGMDVWGQGTTVTVSSASTKGPSV FPLAPSSKSTSGGTAALGCLVKDYFPEPVTVSWNSGALTSGVHT FPAVLQSSGLYSLSSVVTVPSSSLGTQTYICNVNHKPSNTKVDKR VEPKSCGGGGSQVQLVQSGAEVKKPGSSVKVSCKASGGTFSRG AISWVRQAPGQGLEWMGGIIPIEGTAYYAQKFQGRVTITADEST GTAYMELSSLRSEDTAVYYCARQSDYGLPRGMDVWGQGTTVT VSSASTKGPSVFPLAPSSKSTSGGTAALGCLVKDYFPEPVTVSW NSGALTSGVHTFPAVLQSSGLYSLSSVVTVPSSSLGTQTYICNVN HKPSNTKVDKRVEPKSCDKTHTCPPCPAPELLGGPSVFLFPPKPK DTLMISRTPEVTCVVVDVSHEDPEVKFNWYVDGVEVHNAKTKP REEQYNSTYRVVSVLTVLHQDWLNGKEYKCKVSNKALPAPIEK TISKAKGQPREPQVYTLPPSREEMTKNQVSLTCLVKGFYPSDIAV EWESNGQPENNYKTTPPVLDSDGSFFLYSKLTVDKSRWQQGNV FSCSVMHEALHNHYTQKSLSLSPGK |
| 202 | ABP81 | Full Heavy, N terminal Fab TM (IgG1 Fab, IgG1 (G1m(3))) | QVQLVQSGAEVKKPGSSVKVSCKASGGTFSSYAISWVRQAPGQ GLEWMGGIIPISGFTNYAQKFQGRVTITADESTSTAYMELSSLRS EDTAVYYCAREGGHYYSGWPYWGQGTLVTVSSASTKGPSVFP LAPSSKSTSGGTAALGCLVKDYFPEPVTVSWNSGALTSGVHTFP AVLQSSGLYSLSSVVTVPSSSLGTQTYICNVNHKPSNTKVDKRV EPKSCGGGGSQVQLVQSGAEVKKPGSSVKVSCKASGGTFSSYAI SWVRQAPGQGLEWMGGIIPISGFTNYAQKFQGRVTITADESTST AYMELSSLRSEDTAVYYCAREGGHYYSGWPYWGQGTLVTVSS ASTKGPSVFPLAPSSKSTSGGTAALGCLVKDYFPEPVTVSWNSG ALTSGVHTFPAVLQSSGLYSLSSVVTVPSSSLGTQTYICNVNHKP SNTKVDKRVEPKSCDKTHTCPPCPAPELLGGPSVFLFPPKPKDTL MISRTPEVTCVVVDVSHEDPEVKFNWYVDGVEVHNAKTKPREE QYNSTYRVVSVLTVLHQDWLNGKEYKCKVSNKALPAPIEKTIS KAKGQPREPQVYTLPPSREEMTKNQVSLTCLVKGFYPSDIAVE WESNGQPENNYKTTPPVLDSDGSFFLYSKLTVDKSRWQQGNVF SCSVMHEALHNHYTQKSLSLSPGK |
| 203 | ABP82 | Full Heavy, N terminal Fab TM (IgG1 Fab, IgG1 (G1m(3))) | QVQLVQSGAEVKKPGSSVKVSCKASGGTFSSYAISWVRQAPGQ RLEWMGGIIPISGFTNYAQKFQGRVTITADESTSTAYMELSSLRS EDTAVYYCAREGGHYYSGWPYWGQGTLVTVSSASTKGPSVFP LAPSSKSTSGGTAALGCLVKDYFPEPVTVSWNSGALTSGVHTFP AVLQSSGLYSLSSVVTVPSSSLGTQTYICNVNHKPSNTKVDKRV EPKSCGGGGSQVQLVQSGAEVKKPGSSVKVSCKASGGTFSSYAI SWVRQAPGQRLEWMGGIIPISGFTNYAQKFQGRVTITADESTST AYMELSSLRSEDTAVYYCAREGGHYYSGWPYWGQGTLVTVSS ASTKGPSVFPLAPSSKSTSGGTAALGCLVKDYFPEPVTVSWNSG ALTSGVHTFPAVLQSSGLYSLSSVVTVPSSSLGTQTYICNVNHKP SNTKVDKRVEPKSCDKTHTCPPCPAPELLGGPSVFLFPPKPKDTL MISRTPEVTCVVVDVSHEDPEVKFNWYVDGVEVHNAKTKPREE QYNSTYRVVSVLTVLHQDWLNGKEYKCKVSNKALPAPIEKTIS KAKGQPREPQVYTLPPSREEMTKNQVSLTCLVKGFYPSDIAVE |

APPENDIX A-continued

SEQUENCES

| SEQ ID NO | Molecule | Description | SEQUENCE |
|---|---|---|---|
| | | | WESNGQPENNYKTTPPVLDSDGSFFLYSKLTVDKSRWQQGNVF SCSVMHEALHNHYTQKSLSLSPGK |
| 204 | ABP83 | Full Heavy, N terminal Fab TM (IgG1 Fab, IgG1 (G1m(3))) | QVQLVQSGAEVKKPGSSVKVSCKASGGTFSSYAISWVRQAPGQ GLEWMGGIIPISGFTNYAQKFQGKVTITADESTSTAYMELSSLRS EDTAVYYCAREGGHYYSGWPYWGQGTLVTVSSASTKGPSVFP LAPSSKSTSGGTAALGCLVKDYFPEPVTVSWNSGALTSGVHTFP AVLQSSGLYSLSSVVTVPSSSLGTQTYICNVNHKPSNTKVDKRV EPKSCGGGGSQVQLVQSGAEVKKPGSSVKVSCKASGGTFSSYAI SWVRQAPGQGLEWMGGIIPISGFTNYAQKFQGKVTITADESTST AYMELSSLRSEDTAVYYCAREGGHYYSGWPYWGQGTLVTVSS ASTKGPSVFPLAPSSKSTSGGTAALGCLVKDYFPEPVTVSWNSG ALTSGVHTFPAVLQSSGLYSLSSVVTVPSSSLGTQTYICNVNHKP SNTKVDKRVEPKSCDKTHTCPPCPAPELLGGPSVFLFPPKPKDTL MISRTPEVTCVVVDVSHEDPEVKFNWYVDGVEVHNAKTKPREE QYNSTYRVVSVLTVLHQDWLNGKEYKCKVSNKALPAPIEKTIS KAKGQPREPQVYTLPPSREEMTKNQVSLTCLVKGFYPSDIAVE WESNGQPENNYKTTPPVLDSDGSFFLYSKLTVDKSRWQQGNVF SCSVMHEALHNHYTQKSLSLSPGK |
| 205 | ABP84 | Full Heavy, N terminal Fab TM (IgG1 Fab, IgG1 (G1m(3))) | QVQLVQSGAEVKKPGSSVKVSCKASGGTFVRYAISWVRQAPGQ GLEWMGGIIPIFGEAQYAQRFQGRVTITADESTSTAYMELSSLRS EDTAVYYCAREGYYYGALPYWGQGTLVTVSSASTKGPSVFPLA PSSKSTSGGTAALGCLVKDYFPEPVTVSWNSGALTSGVHTFPAV LQSSGLYSLSSVVTVPSSSLGTQTYICNVNHKPSNTKVDKRVEP KSCGGGGSQVQLVQSGAEVKKPGSSVKVSCKASGGTFVRYAIS WVRQAPGQGLEWMGGIIPIFGEAQYAQRFQGRVTITADESTSTA YMELSSLRSEDTAVYYCAREGYYYGALPYWGQGTLVTVSSAST KGPSVFPLAPSSKSTSGGTAALGCLVKDYFPEPVTVSWNSGALT SGVHTFPAVLQSSGLYSLSSVVTVPSSSLGTQTYICNVNHKPSNT KVDKRVEPKSCDKTHTCPPCPAPELLGGPSVFLFPPKPKDTLMIS RTPEVTCVVVDVSHEDPEVKFNWYVDGVEVHNAKTKPREEQY NSTYRVVSVLTVLHQDWLNGKEYKCKVSNKALPAPIEKTISKA KGQPREPQVYTLPPSREEMTKNQVSLTCLVKGFYPSDIAVEWES NGQPENNYKTTPPVLDSDGSFFLYSKLTVDKSRWQQGNVFSCS VMHEALHNHYTQKSLSLSPGK |
| 206 | ABP85 | Full Heavy, N terminal Fab TM (IgG1 Fab, IgG1 (G1m(3))) | QVQLVQSGAEVKKPGSSVKVSCKASGGTFVRYAISWVRQAPGQ GLEWMGGIIPIFGEAQYAQKFRGRATITADESTSTAYMELSSLRS EDTAVYYCAREGYYYGALPYWGQGTLVTVSSASTKGPSVFPLA PSSKSTSGGTAALGCLVKDYFPEPVTVSWNSGALTSGVHTFPAV LQSSGLYSLSSVVTVPSSSLGTQTYICNVNHKPSNTKVDKRVEP KSCGGGGSQVQLVQSGAEVKKPGSSVKVSCKASGGTFVRYAIS WVRQAPGQGLEWMGGIIPIFGEAQYAQKFRGRATITADESTSTA YMELSSLRSEDTAVYYCAREGYYYGALPYWGQGTLVTVSSAST KGPSVFPLAPSSKSTSGGTAALGCLVKDYFPEPVTVSWNSGALT SGVHTFPAVLQSSGLYSLSSVVTVPSSSLGTQTYICNVNHKPSNT KVDKRVEPKSCDKTHTCPPCPAPELLGGPSVFLFPPKPKDTLMIS RTPEVTCVVVDVSHEDPEVKFNWYVDGVEVHNAKTKPREEQY NSTYRVVSVLTVLHQDWLNGKEYKCKVSNKALPAPIEKTISKA KGQPREPQVYTLPPSREEMTKNQVSLTCLVKGFYPSDIAVEWES NGQPENNYKTTPPVLDSDGSFFLYSKLTVDKSRWQQGNVFSCS VMHEALHNHYTQKSLSLSPGK |
| 207 | ABP86 | Full Heavy, C terminal Fab TM, linker = 5 mer (IgG1 (G1m(3)), IgG1 Fab) | QVQLVQSGAEVKRPGSSVKVSCKASGGTFSSYYISWVRQVPGQ GLEWMGGIIPVPGTANYAQKFQGRVTITADESTSTAYMELSSLR SEDTAVYYCARAGGGYYARGDHYYGMDVWGQGTTVTVSSAST KGPSVFPLAPSSKSTSGGTAALGCLVKDYFPEPVTVSWNSGALT SGVHTFPAVLQSSGLYSLSSVVTVPSSSLGTQTYICNVNHKPSNT KVDKRVEPKSCDKTHTCPPCPAPELLGGPSVFLFPPKPKDTLMIS RTPEVTCVVVDVSHEDPEVKFNWYVDGVEVHNAKTKPREEQY NSTYRVVSVLTVLHQDWLNGKEYKCKVSNKALPAPIEKTISKA KGQPREPQVYTLPPSREEMTKNQVSLTCLVKGFYPSDIAVEWES NGQPENNYKTTPPVLDSDGSFFLYSKLTVDKSRWQQGNVFSCS VMHEALHNHYTQKSLSLSPGKGGGGSQVQLVQSGAEVKRPGSS VKVSCKASGGTFSSYYISWVRQVPGQGLEWMGGIIPVPGTANY AQKFQGRVTITADESTSTAYMELSSLRSEDTAVYYCARAGGGY ARGDHYYGMDVWGQGTTVTVSSASTKGPSVFPLAPSSKSTSGG TAALGCLVKDYFPEPVTVSWNSGALTSGVHTFPAVLQSSGLYSL SSVVTVPSSSLGTQTYICNVNHKPSNTKVDKRVEPKSC |
| 208 | ABP87 | Full Heavy, C terminal Fab TM, linker = | QVQLVQSGAEVKKPGSSVKVSCKASGGTFSSYYISWVRQAPGQ RLEWMGGIIPVPGTANYAQKFQGRVTITADESTSTAYMELSSLR SEDTAVYYCARAGGGYARGDHYYGMDVVVGQGTTVTVSSAST |

APPENDIX A-continued

SEQUENCES

| SEQ ID NO | Molecule | Description | SEQUENCE |
|---|---|---|---|
| | | 5 mer (IgG1 (G1m(3)), IgG1 Fab) | KVDKRVEPKSCDKTHTCPPCPAPELLGGPSVFLFPPKPKDTLMIS SGVHTFPAVLQSSGLYSLSSVVTVPSSSLGQTYICNVNHKPSNT RTPEVTCVVVDVSHEDPEVKFNWYVDGVEVHNAKTKPREEQY NSTYRVVSVLTVLHQDWLNGKEYKCKVSNKALPAPIEKTISKA KGQPREPQVYTLPPSREEMTKNQVSLTCLVKGFYPSDIAVEWES NGQPENNYKTTPPVLDSDGSFFLYSKLTVDKSRWQQGNVFSCS VMHEALHNHYTQKSLSLSPGKGGGGSQVQLVQSGAEVKKPGSS VKVSCKASGGTFSSYYISWVRQAPGQRLEWMGGIIPVPGTANY AQKFQGRVTITADESTSTAYMELSSLRSEDTAVYYCARAGGGY ARGDHYYGMDVVVGQGTTVTVSSASTKGPSVFPLAPSSKSTSGG TAALGCLVKDYFPEPVTVSWNSGALTSGVHTFPAVLQSSGLYSL SSVVTVPSSSLGTQTYICNVNHKPSNTKVDKRVEPKSC |
| 209 | ABP88 | Full Heavy, C terminal Fab TM, linker = 5 mer (IgG1 (G1m(3)), IgG1 Fab) | QVQLVQSGAEVKKPGSSVKVSCKASGGTFSRGAISWVRQAPGQ GLEWMGGIIPIEGTAYYAQKFQGRVTITADESTGTAYMELSSLR SEDTAVYYCARQSDYGLPRGMDVVVGQGTTVTVSSASTKGPSV FPLAPSSKSTSGGTAALGCLVKDYFPEPVTVSWNSGALTSGVHT FPAVLQSSGLYSLSSVVTVPSSSLGTQTYICNVNHKPSNTKVDKR VEPKSCDKTHTCPPCPAPELLGGPSVFLFPPKPKDTLMISRTPEVT CVVVDVSHEDPEVKFNWYVDGVEVHNAKTKPREEQYNSTYRV VSVLTVLHQDWLNGKEYKCKVSNKALPAPIEKTISKAKGQPREP QVYTLPPSREEMTKNQVSLTCLVKGFYPSDIAVEWESNGQPENN YKTTPPVLDSDGSFFLYSKLTVDKSRWQQGNVFSCSVMHEALH NHYTQKSLSLSPGKGGGGSQVQLVQSGAEVKKPGSSVKVSCKA SGGTFSRGAISWVRQAPGQGLEWMGGIIPIEGTAYYAQKFQGRV TITADESTGTAYMELSSLRSEDTAVYYCARQSDYGLPRGMDVVV GQGTTVTVSSASTKGPSVFPLAPSSKSTSGGTAALGCLVKDYFP EPVTVSWNSGALTSGVHTFPAVLQSSGLYSLSSVVTVPSSSLGT QTYICNVNHKPSNTKVDKRVEPKSC |
| 210 | ABP89 | Full Heavy, C terminal Fab TM, linker = 5 mer (IgG1 (G1m(3)), IgG1 Fab) | QVQLVQSGAEVKKPGSSVKVSCKASGGTFSSYAISWVRQAPGQ GLEWMGGIIPISGFTNYAQKFQGRVTITADESTSTAYMELSSLRS EDTAVYYCAREGGHYYSGWPYWGQGTLVTVSSASTKGPSVFP LAPSSKSTSGGTAALGCLVKDYFPEPVTVSWNSGALTSGVHTFP AVLQSSGLYSLSSVVTVPSSSLGTQTYICNVNHKPSNTKVDKRV EPKSCDKTHTCPPCPAPELLGGPSVFLFPPKPKDTLMISRTPEVTC VVVDVSHEDPEVKFNWYVDGVEVHNAKTKPREEQYNSTYRVV SVLTVLHQDWLNGKEYKCKVSNKALPAPIEKTISKAKGQPREPQ VYTLPPSREEMTKNQVSLTCLVKGFYPSDIAVEWESNGQPENNY KTTPPVLDSDGSFFLYSKLTVDKSRWQQGNVFSCSVMHEALHN HYTQKSLSLSPGKGGGGSQVQLVQSGAEVKKPGSSVKVSCKAS GGTFSSYAISWVRQAPGQGLEWMGGIIPISGFTNYAQKFQGRVT ITADESTSTAYMELSSLRSEDTAVYYCAREGGHYYSGWPYWGQ GTLVTVSSASTKGPSVFPLAPSSKSTSGGTAALGCLVKDYFPEPV TVSWNSGALTSGVHTFPAVLQSSGLYSLSSVVTVPSSSLGTQTYI CNVNHKPSNTKVDKRVEPKSC |
| 211 | ABP90 | Full Heavy, C terminal Fab TM, linker = 5 mer (IgG1 (G1m(3)), IgG1 Fab) | QVQLVQSGAEVKKPGSSVKVSCKASGGTFSSYAISWVRQAPGQ RLEWMGGIIPISGFTNYAQKFQGRVTITADESTSTAYMELSSLRS EDTAVYYCAREGGHYYSGWPYWGQGTLVTVSSASTKGPSVFP LAPSSKSTSGGTAALGCLVKDYFPEPVTVSWNSGALTSGVHTFP AVLQSSGLYSLSSVVTVPSSSLGTQTYICNVNHKPSNTKVDKRV EPKSCDKTHTCPPCPAPELLGGPSVFLFPPKPKDTLMISRTPEVTC VVVDVSHEDPEVKFNWYVDGVEVHNAKTKPREEQYNSTYRVV SVLTVLHQDWLNGKEYKCKVSNKALPAPIEKTISKAKGQPREPQ VYTLPPSREEMTKNQVSLTCLVKGFYPSDIAVEWESNGQPENNY KTTPPVLDSDGSFFLYSKLTVDKSRWQQGNVFSCSVMHEALHN HYTQKSLSLSPGKGGGGSQVQLVQSGAEVKKPGSSVKVSCKAS GGTFSSYAISWVRQAPGQRLEWMGGIIPISGFTNYAQKFQGRVTI TADESTSTAYMELSSLRSEDTAVYYCAREGGHYYSGWPYWGQ GTLVTVSSASTKGPSVFPLAPSSKSTSGGTAALGCLVKDYFPEPV TVSWNSGALTSGVHTFPAVLQSSGLYSLSSVVTVPSSSLGTQTYI CNVNHKPSNTKVDKRVEPKSC |
| 212 | ABP91 | Full Heavy, C terminal Fab TM, linker = 5 mer (IgG1 (G1m(3)), IgG1 Fab) | QVQLVQSGAEVKKPGSSVKVSCKASGGTFSSYAISWVRQAPGQ GLEWMGGIIPISGFTNYAQKFQGKVTITADESTSTAYMELSSLRS EDTAVYYCAREGGHYYSGWPYWGQGTLVTVSSASTKGPSVFP LAPSSKSTSGGTAALGCLVKDYFPEPVTVSWNSGALTSGVHTFP AVLQSSGLYSLSSVVTVPSSSLGTQTYICNVNHKPSNTKVDKRV EPKSCDKTHTCPPCPAPELLGGPSVFLFPPKPKDTLMISRTPEVTC VVVDVSHEDPEVKFNWYVDGVEVHNAKTKPREEQYNSTYRVV SVLTVLHQDWLNGKEYKCKVSNKALPAPIEKTISKAKGQPREPQ VYTLPPSREEMTKNQVSLTCLVKGFYPSDIAVEWESNGQPENNY KTTPPVLDSDGSFFLYSKLTVDKSRWQQGNVFSCSVMHEALHN |

APPENDIX A-continued

SEQUENCES

| SEQ ID NO | Molecule | Description | SEQUENCE |
|---|---|---|---|
| | | | HYTQKSLSLSPGKGGGGSQVQLVQSGAEVKKPGSSVKVSCKAS GGTFSSYAISWVRQAPGQGLEWMGGIIPISGFTNYAQKFQGKVT ITADESTSTAYMELSSLRSEDTAVYYCAREGGHYYSGWPYWGQ GTLVTVSSASTKGPSVFPLAPSSKSTSGGTAALGCLVKDYFPEPV TVSWNSGALTSGVHTFPAVLQSSGLYSLSSVVTVPSSSLGTQTYI CNVNHKPSNTKVDKRVEPKSC |
| 213 | ABP92 | Full Heavy, C terminal Fab TM, linker = 5 mer (IgG1 (G1m(3)), IgG1 Fab) | QVQLVQSGAEVKKPGSSVKVSCKASGGTFVRYAISWVRQAPGQ GLEWMGGIIPIFGEAQYAQRFQGRVTITADESTSTAYMELSSLRS EDTAVYYCAREGYYYGALPYWGQGTLVTVSSASTKGPSVFPLA PSSKSTSGGTAALGCLVKDYFPEPVTVSWNSGALTSGVHTFPAV LQSSGLYSLSSVVTVPSSSLGTQTYICNVNHKPSNTKVDKRVEP KSCDKTHTCPPCPAPELLGGPSVFLFPPKPKDTLMISRTPEVTCV VVDVSHEDPEVKFNWYVDGVEVHNAKTKPREEQYNSTYRVVS VLTVLHQDWLNGKEYKCKVSNKALPAPIEKTISKAKGQPREPQ VYTLPPSREEMTKNQVSLTCLVKGFYPSDIAVEWESNGQPENNY KTTPPVLDSDGSFFLYSKLTVDKSRWQQGNVFSCSVMHEALHN HYTQKSLSLSPGKGGGGSQVQLVQSGAEVKKPGSSVKVSCKAS GGTFVRYAISWVRQAPGQGLEWMGGIIPIFGEAQYAQRFQGRV TITADESTSTAYMELSSLRSEDTAVYYCAREGYYYGALPYWGQ GTLVTVSSASTKGPSVFPLAPSSKSTSGGTAALGCLVKDYFPEPV TVSWNSGALTSGVHTFPAVLQSSGLYSLSSVVTVPSSSLGTQTYI CNVNHKPSNTKVDKRVEPKSC |
| 214 | ABP93 | Full Heavy, C terminal Fab TM, linker = 5 mer (IgG1 (G1m(3)), IgG1 Fab) | QVQLVQSGAEVKKPGSSVKVSCKASGGTFVRYAISWVRQAPGQ GLEWMGGIIPIFGEAQYAQKFRGRATITADESTSTAYMELSSLRS EDTAVYYCAREGYYYGALPYWGQGTLVTVSSASTKGPSVFPLA PSSKSTSGGTAALGCLVKDYFPEPVTVSWNSGALTSGVHTFPAV LQSSGLYSLSSVVTVPSSSLGTQTYICNVNHKPSNTKVDKRVEP KSCDKTHTCPPCPAPELLGGPSVFLFPPKPKDTLMISRTPEVTCV VVDVSHEDPEVKFNWYVDGVEVHNAKTKPREEQYNSTYRVVS VLTVLHQDWLNGKEYKCKVSNKALPAPIEKTISKAKGQPREPQ VYTLPPSREEMTKNQVSLTCLVKGFYPSDIAVEWESNGQPENNY KTTPPVLDSDGSFFLYSKLTVDKSRWQQGNVFSCSVMHEALHN HYTQKSLSLSPGKGGGGSQVQLVQSGAEVKKPGSSVKVSCKAS GGTFVRYAISWVRQAPGQGLEWMGGIIPIFGEAQYAQKFRGRA TITADESTSTAYMELSSLRSEDTAVYYCAREGYYYGALPYWGQ GTLVTVSSASTKGPSVFPLAPSSKSTSGGTAALGCLVKDYFPEPV TVSWNSGALTSGVHTFPAVLQSSGLYSLSSVVTVPSSSLGTQTYI CNVNHKPSNTKVDKRVEPKSC |
| 8 | ABP35 | Full Light | DIQMTQSPSSLSASVGDRVTITCRASQSISSYLNWYQQKPGKAP KLLIYAASSLQSGVPSRFSGSGSGTDFTLTISSLQPEDFATYYCQQ EYATPPTFGGGTKVEIKRTVAAPSVFIFPPSDEQLKSGTASVVCL LNNFYPREAKVQWKVDNALQSGNSQESVTEQDSKDSTYSLSST LTLSKADYEKHKVYACEVTHQGLSSPVTKSFNRGEC |
| 18 | ABP36 | Full Light | DIQMTQSPSSLSASVGDRVTITCRASQSISSYLNWYQQKPGKAP KLLIYAASSLQSGVPSRFSGSGSGTDFTLTISSLQPEDFATYYCQQ EYNTPPTFGGGTKVEIKRTVAAPSVFIFPPSDEQLKSGTASVVCL LNNFYPREAKVQWKVDNALQSGNSQESVTEQDSKDSTYSLSST LTLSKADYEKHKVYACEVTHQGLSSPVTKSFNRGEC |
| 25 | ABP37 | Full Light | DIQMTQSPSSLSASVGDRVTITCRASQSISSYLNWYQQKPGKAP KLLIYAASSLKYGVPSRFSGSGSGTDFTLTISSLQPEDFATYYCQ QEYNTPPTFGGGTKVEIKRTVAAPSVFIFPPSDEQLKSGTASVVC LLNNFYPREAKVQWKVDNALQSGNSQESVTEQDSKDSTYSLSS TLTLSKADYEKHKVYACEVTHQGLSSPVTKSFNRGEC |
| 33 | ABP38 | Full Light | DIQMTQSPSSLSASVGDRVTITCRASKSIDSYLNWYQQKPGKAP KLLIYAASSLQSGVPSRFSGSGSGTDFTLTISSLQPEDFATYYCQQ EYNTPPTFGGGTKVEIKRTVAAPSVFIFPPSDEQLKSGTASVVCL LNNFYPREAKVQWKVDNALQSGNSQESVTEQDSKDSTYSLSST LTLSKADYEKHKVYACEVTHQGLSSPVTKSFNRGEC |
| 39 | ABP39 | Full Light | DIQMTQSPSSLSASVGDRVTITCRASQSISSYLNWYQQKPGKAP KLLIYAADSLQSGVPSRFSGSGSGTDFTLTISSLQPEDFATYYCQ QEYNTPPTFGGGTKVEIKRTVAAPSVFIFPPSDEQLKSGTASVVC LLNNFYPREAKVQWKVDNALQSGNSQESVTEQDSKDSTYSLSS TLTLSKADYEKHKVYACEVTHQGLSSPVTKSFNRGEC |
| 43 | ABP40 | Full Light | DIQMTQSPSSLSASVGDRVTITCRASQSINSYLNWYQQKPGKAP KLLIYAASSLDSGVPSRFSGSGSGTDFTLTISSLQPEDFATYYCQQ EYNTPPTFGGGTKVEIKRTVAAPSVFIFPPSDEQLKSGTASVVCL |

APPENDIX A-continued

SEQUENCES

| SEQ ID NO | Molecule | Description | SEQUENCE |
|---|---|---|---|
| | | | LNNFYPREAKVQWKVDNALQSGNSQESVTEQDSKDSTYSLSST LTLSKADYEKHKVYACEVTHQGLSSPVTKSFNRGEC |
| 52 | ABP41 | Full Light | DIQMTQSPSSLSASVGDRVTITCGASQSISTYLNWYQQKPGKAP KLLIYSASSLESGVPSRFSGSGSGTDFTLTISSLQPEDFATYYCQQ EYNTPPSFGGGTKVEIKRTVAAPSVFIFPPSDEQLKSGTASVVCL LNNFYPREAKVQWKVDNALQSGNSQESVTEQDSKDSTYSLSST LTLSKADYEKHKVYACEVTHQGLSSPVTKSFNRGEC |
| 8 | ABP42 | Full Light | DIQMTQSPSSLSASVGDRVTITCRASQSISSYLNWYQQKPGKAP KLLIYAASSLQSGVPSRFSGSGSGTDFTLTISSLQPEDFATYYCQQ EYATPPTFGGGTKVEIKRTVAAPSVFIFPPSDEQLKSGTASVVCL LNNFYPREAKVQWKVDNALQSGNSQESVTEQDSKDSTYSLSST LTLSKADYEKHKVYACEVTHQGLSSPVTKSFNRGEC |
| 8 | ABP43 | Full Light | DIQMTQSPSSLSASVGDRVTITCRASQSISSYLNWYQQKPGKAP KLLIYAASSLQSGVPSRFSGSGSGTDFTLTISSLQPEDFATYYCQQ EYATPPTFGGGTKVEIKRTVAAPSVFIFPPSDEQLKSGTASVVCL LNNFYPREAKVQWKVDNALQSGNSQESVTEQDSKDSTYSLSST LTLSKADYEKHKVYACEVTHQGLSSPVTKSFNRGEC |
| 107 | ABP44 | Full Light | DIVMTQSPLSLPVTPGEPASISCRSSQSLLHSNGYNYLDWYLQKP GQSPQLLIYLGSNRASGVPDRFSGSGSGTDFTLKISRVEAEDVGV YYCMQKIGTPLTFGGGTKVEIKRTVAAPSVFIFPPSDEQLKSGTA SVVCLLNNFYPREAKVQWKVDNALQSGNSQESVTEQDSKDSTY SLSSTLTLSKADYEKHKVYACEVTHQGLSSPVTKSFNRGEC |
| 109 | ABP45 | Full Light | DIQLTQSPSSVSASVGDRVTITCRASQGISSWLAWYQQKPGKAP KLLIYGASSLQSGVPSRFSGSGSGTDFTLTISSLQPEDFATYYCQQ ASLFPPTFGGGTKVEIKRTVAAPSVFIFPPSDEQLKSGTASVVCLL NNFYPREAKVQWKVDNALQSGNSQESVTEQDSKDSTYSLSSTL TLSKADYEKHKVYACEVTHQGLSSPVTKSFNRGEC |
| 111 | ABP46 | Full Light | EIVLTQSPATLSLSPGERATLSCRASQSVSSYLAWYQQKPGQAP RLLIYDASNRATGIPARFSGSGSGTDFTLTISSLEPEDFAVYYCQQ RLVFPPTFGGGTKVEIKRTVAAPSVFIFPPSDEQLKSGTASVVCL LNNFYPREAKVQWKVDNALQSGNSQESVTEQDSKDSTYSLSST LTLSKADYEKHKVYACEVTHQGLSSPVTKSFNRGEC |
| 113 | ABP47 | Full Light | EIVLTQSPATLSLSPGERATLSCRASQSVSSYLAWYQQKPGQAP RLLIYDASNRATGIPARFSGSGSGTDFTLTISSLEPEDFAVYYCQQ HSVFPPTFGGGTKVEIKRTVAAPSVFIFPPSDEQLKSGTASVVCL LNNFYPREAKVQWKVDNALQSGNSQESVTEQDSKDSTYSLSST LTLSKADYEKHKVYACEVTHQGLSSPVTKSFNRGEC |
| 8 | ABP48 | Full Light | DIQMTQSPSSLSASVGDRVTITCRASQSISSYLNWYQQKPGKAP KLLIYAASSLQSGVPSRFSGSGSGTDFTLTISSLQPEDFATYYCQQ EYATPPTFGGGTKVEIKRTVAAPSVFIFPPSDEQLKSGTASVVCL LNNFYPREAKVQWKVDNALQSGNSQESVTEQDSKDSTYSLSST LTLSKADYEKHKVYACEVTHQGLSSPVTKSFNRGEC |
| 8 | ABP49 | Full Light | DIQMTQSPSSLSASVGDRVTITCRASQSISSYLNWYQQKPGKAP KLLIYAASSLQSGVPSRFSGSGSGTDFTLTISSLQPEDFATYYCQQ EYATPPTFGGGTKVEIKRTVAAPSVFIFPPSDEQLKSGTASVVCL LNNFYPREAKVQWKVDNALQSGNSQESVTEQDSKDSTYSLSST LTLSKADYEKHKVYACEVTHQGLSSPVTKSFNRGEC |
| 107 | ABP50 | Full Light | DIVMTQSPLSLPVTPGEPASISCRSSQSLLHSNGYNYLDWYLQKP GQSPQLLIYLGSNRASGVPDRFSGSGSGTDFTLKISRVEAEDVGV YYCMQKIGTPLTFGGGTKVEIKRTVAAPSVFIFPPSDEQLKSGTA SVVCLLNNFYPREAKVQWKVDNALQSGNSQESVTEQDSKDSTY SLSSTLTLSKADYEKHKVYACEVTHQGLSSPVTKSFNRGEC |
| 107 | ABP51 | Full Light | DIVMTQSPLSLPVTPGEPASISCRSSQSLLHSNGYNYLDWYLQKP GQSPQLLIYLGSNRASGVPDRFSGSGSGTDFTLKISRVEAEDVGV YYCMQKIGTPLTFGGGTKVEIKRTVAAPSVFIFPPSDEQLKSGTA SVVCLLNNFYPREAKVQWKVDNALQSGNSQESVTEQDSKDSTY SLSSTLTLSKADYEKHKVYACEVTHQGLSSPVTKSFNRGEC |
| 109 | ABP52 | Full Light | DIQLTQSPSSVSASVGDRVTITCRASQGISSWLAWYQQKPGKAP KLLIYGASSLQSGVPSRFSGSGSGTDFTLTISSLQPEDFATYYCQQ ASLFPPTFGGGTKVEIKRTVAAPSVFIFPPSDEQLKSGTASVVCLL NNFYPREAKVQWKVDNALQSGNSQESVTEQDSKDSTYSLSSTL TLSKADYEKHKVYACEVTHQGLSSPVTKSFNRGEC |

APPENDIX A-continued

SEQUENCES

| SEQ ID NO | Molecule | Description | SEQUENCE |
|---|---|---|---|
| 111 | ABP53 | Full Light | EIVLTQSPATLSLSPGERATLSCRASQSVSSYLAWYQQKPGQAP RLLIYDASNRATGIPARFSGSGSGTDFTLTISSLEPEDFAVYYCQQ RLVFPPTFGGGTKVEIKRTVAAPSVFIFPPSDEQLKSGTASVVCL LNNFYPREAKVQWKVDNALQSGNSQESVTEQDSKDSTYSLSST LTLSKADYEKHKVYACEVTHQGLSSPVTKSFNRGEC |
| 111 | ABP54 | Full Light | EIVLTQSPATLSLSPGERATLSCRASQSVSSYLAWYQQKPGQAP RLLIYDASNRATGIPARFSGSGSGTDFTLTISSLEPEDFAVYYCQQ RLVFPPTFGGGTKVEIKRTVAAPSVFIFPPSDEQLKSGTASVVCL LNNFYPREAKVQWKVDNALQSGNSQESVTEQDSKDSTYSLSST LTLSKADYEKHKVYACEVTHQGLSSPVTKSFNRGEC |
| 111 | ABP55 | Full Light | EIVLTQSPATLSLSPGERATLSCRASQSVSSYLAWYQQKPGQAP RLLIYDASNRATGIPARFSGSGSGTDFTLTISSLEPEDFAVYYCQQ RLVFPPTFGGGTKVEIKRTVAAPSVFIFPPSDEQLKSGTASVVCL LNNFYPREAKVQWKVDNALQSGNSQESVTEQDSKDSTYSLSST LTLSKADYEKHKVYACEVTHQGLSSPVTKSFNRGEC |
| 113 | ABP56 | Full Light | EIVLTQSPATLSLSPGERATLSCRASQSVSSYLAWYQQKPGQAP RLLIYDASNRATGIPARFSGSGSGTDFTLTISSLEPEDFAVYYCQQ HSVFPPTFGGGTKVEIKRTVAAPSVFIFPPSDEQLKSGTASVVCL LNNFYPREAKVQWKVDNALQSGNSQESVTEQDSKDSTYSLSST LTLSKADYEKHKVYACEVTHQGLSSPVTKSFNRGEC |
| 113 | ABP57 | Full Light | EIVLTQSPATLSLSPGERATLSCRASQSVSSYLAWYQQKPGQAP RLLIYDASNRATGIPARFSGSGSGTDFTLTISSLEPEDFAVYYCQQ HSVFPPTFGGGTKVEIKRTVAAPSVFIFPPSDEQLKSGTASVVCL LNNFYPREAKVQWKVDNALQSGNSQESVTEQDSKDSTYSLSST LTLSKADYEKHKVYACEVTHQGLSSPVTKSFNRGEC |
| 125 | ABP58 | Full Light | DIVMTQSPLSLPVTPGEPASISCRSSQSLLHSNGYNYLDWYLQKP GQSPQLLIYLGSNRASGVPDRFSGSGSGTDFTLKISRVEAEDVGV YYCMQALQTPITFGGGTKVEIKRTVAAPSVFIFPPSDEQLKSGTA SVVCLLNNFYPREAKVQWKVDNALQSGNSQESVTEQDSKDSTY SLSSTLTLSKADYEKHKVYACEVTHQGLSSPVTKSFNRGEC |
| 125 | ABP59 | Full Light | DIVMTQSPLSLPVTPGEPASISCRSSQSLLHSNGYNYLDWYLQKP GQSPQLLIYLGSNRASGVPDRFSGSGSGTDFTLKISRVEAEDVGV YYCMQALQTPITFGGGTKVEIKRTVAAPSVFIFPPSDEQLKSGTA SVVCLLNNFYPREAKVQWKVDNALQSGNSQESVTEQDSKDSTY SLSSTLTLSKADYEKHKVYACEVTHQGLSSPVTKSFNRGEC |
| 125 | ABP60 | Full Light | DIVMTQSPLSLPVTPGEPASISCRSSQSLLHSNGYNYLDWYLQKP GQSPQLLIYLGSNRASGVPDRFSGSGSGTDFTLKISRVEAEDVGV YYCMQALQTPITFGGGTKVEIKRTVAAPSVFIFPPSDEQLKSGTA SVVCLLNNFYPREAKVQWKVDNALQSGNSQESVTEQDSKDSTY SLSSTLTLSKADYEKHKVYACEVTHQGLSSPVTKSFNRGEC |
| 125 | ABP61 | Full Light | DIVMTQSPLSLPVTPGEPASISCRSSQSLLHSNGYNYLDWYLQKP GQSPQLLIYLGSNRASGVPDRFSGSGSGTDFTLKISRVEAEDVGV YYCMQALQTPITFGGGTKVEIKRTVAAPSVFIFPPSDEQLKSGTA SVVCLLNNFYPREAKVQWKVDNALQSGNSQESVTEQDSKDSTY SLSSTLTLSKADYEKHKVYACEVTHQGLSSPVTKSFNRGEC |
| 8 | ABP62 | Full Light | DIQMTQSPSSLSASVGDRVTITCRASQSISSYLNWYQQKPGKAP KLLIYAASSLQSGVPSRFSGSGSGTDFTLTISSLQPEDFATYYCQQ EYATPPTFGGGTKVEIKRTVAAPSVFIFPPSDEQLKSGTASVVCL LNNFYPREAKVQWKVDNALQSGNSQESVTEQDSKDSTYSLSST LTLSKADYEKHKVYACEVTHQGLSSPVTKSFNRGEC |
| 18 | ABP63 | Full Light | DIQMTQSPSSLSASVGDRVTITCRASQSISSYLNWYQQKPGKAP KLLIYAASSLQSGVPSRFSGSGSGTDFTLTISSLQPEDFATYYCQQ EYNTPPTFGGGTKVEIKRTVAAPSVFIFPPSDEQLKSGTASVVCL LNNFYPREAKVQWKVDNALQSGNSQESVTEQDSKDSTYSLSST LTLSKADYEKHKVYACEVTHQGLSSPVTKSFNRGEC |
| 25 | ABP64 | Full Light | DIQMTQSPSSLSASVGDRVTITCRASQSISSYLNWYQQKPGKAP KLLIYAASSLKYGVPSRFSGSGSGTDFTLTISSLQPEDFATYYCQ QEYNTPPTFGGGTKVEIKRTVAAPSVFIFPPSDEQLKSGTASVVC LLNNFYPREAKVQWKVDNALQSGNSQESVTEQDSKDSTYSLSS TLTLSKADYEKHKVYACEVTHQGLSSPVTKSFNRGEC |

APPENDIX A-continued

SEQUENCES

| SEQ ID NO | Molecule | Description | SEQUENCE |
|---|---|---|---|
| 33 | ABP65 | Full Light | DIQMTQSPSSLSASVGDRVTITCRASKSIDSYLNWYQQKPGKAP KLLIYAASSLQSGVPSRFSGSGSGTDFTLTISSLQPEDFATYYCQQ EYNTPPTFGGGTKVEIKRTVAAPSVFIFPPSDEQLKSGTASVVCL LNNFYPREAKVQWKVDNALQSGNSQESVTEQDSKDSTYSLSST LTLSKADYEKHKVYACEVTHQGLSSPVTKSFNRGEC |
| 33 | ABP66 | Full Light | DIQMTQSPSSLSASVGDRVTITCRASKSIDSYLNWYQQKPGKAP KLLIYAASSLQSGVPSRFSGSGSGTDFTLTISSLQPEDFATYYCQQ EYNTPPTFGGGTKVEIKRTVAAPSVFIFPPSDEQLKSGTASVVCL LNNFYPREAKVQWKVDNALQSGNSQESVTEQDSKDSTYSLSST LTLSKADYEKHKVYACEVTHQGLSSPVTKSFNRGEC |
| 39 | ABP67 | Full Light | DIQMTQSPSSLSASVGDRVTITCRASQSISSYLNWYQQKPGKAP KLLIYAADSLQSGVPSRFSGSGSGTDFTLTISSLQPEDFATYYCQ QEYNTPPTFGGGTKVEIKRTVAAPSVFIFPPSDEQLKSGTASVVC LLNNFYPREAKVQWKVDNALQSGNSQESVTEQDSKDSTYSLSS TLTLSKADYEKHKVYACEVTHQGLSSPVTKSFNRGEC |
| 43 | ABP68 | Full Light | DIQMTQSPSSLSASVGDRVTITCRASQSINSYLNWYQQKPGKAP KLLIYAASSLDSGVPSRFSGSGSGTDFTLTISSLQPEDFATYYCQQ EYNTPPTFGGGTKVEIKRTVAAPSVFIFPPSDEQLKSGTASVVCL LNNFYPREAKVQWKVDNALQSGNSQESVTEQDSKDSTYSLSST LTLSKADYEKHKVYACEVTHQGLSSPVTKSFNRGEC |
| 52 | ABP69 | Full Light | DIQMTQSPSSLSASVGDRVTITCGASQSISTYLNWYQQKPGKAP KLLIYSASSLESGVPSRFSGSGSGTDFTLTISSLQPEDFATYYCQQ EYNTPPSFGGGTKVEIKRTVAAPSVFIFPPSDEQLKSGTASVVCL LNNFYPREAKVQWKVDNALQSGNSQESVTEQDSKDSTYSLSST LTLSKADYEKHKVYACEVTHQGLSSPVTKSFNRGEC |
| 8 | ABP70 | Full Light | DIQMTQSPSSLSASVGDRVTITCRASQSISSYLNWYQQKPGKAP KLLIYAASSLQSGVPSRFSGSGSGTDFTLTISSLQPEDFATYYCQQ EYATPPTFGGGTKVEIKRTVAAPSVFIFPPSDEQLKSGTASVVCL LNNFYPREAKVQWKVDNALQSGNSQESVTEQDSKDSTYSLSST LTLSKADYEKHKVYACEVTHQGLSSPVTKSFNRGEC |
| 18 | ABP71 | Full Light | DIQMTQSPSSLSASVGDRVTITCRASQSISSYLNWYQQKPGKAP KLLIYAASSLQSGVPSRFSGSGSGTDFTLTISSLQPEDFATYYCQQ EYNTPPTFGGGTKVEIKRTVAAPSVFIFPPSDEQLKSGTASVVCL LNNFYPREAKVQWKVDNALQSGNSQESVTEQDSKDSTYSLSST LTLSKADYEKHKVYACEVTHQGLSSPVTKSFNRGEC |
| 25 | ABP72 | Full Light | DIQMTQSPSSLSASVGDRVTITCRASQSISSYLNWYQQKPGKAP KLLIYAASSLKYGVPSRFSGSGSGTDFTLTISSLQPEDFATYYCQ QEYNTPPTFGGGTKVEIKRTVAAPSVFIFPPSDEQLKSGTASVVC LLNNFYPREAKVQWKVDNALQSGNSQESVTEQDSKDSTYSLSS TLTLSKADYEKHKVYACEVTHQGLSSPVTKSFNRGEC |
| 33 | ABP73 | Full Light | DIQMTQSPSSLSASVGDRVTITCRASKSIDSYLNWYQQKPGKAP KLLIYAASSLQSGVPSRFSGSGSGTDFTLTISSLQPEDFATYYCQQ EYNTPPTFGGGTKVEIKRTVAAPSVFIFPPSDEQLKSGTASVVCL LNNFYPREAKVQWKVDNALQSGNSQESVTEQDSKDSTYSLSST LTLSKADYEKHKVYACEVTHQGLSSPVTKSFNRGEC |
| 33 | ABP74 | Full Light | DIQMTQSPSSLSASVGDRVTITCRASKSIDSYLNWYQQKPGKAP KLLIYAASSLQSGVPSRFSGSGSGTDFTLTISSLQPEDFATYYCQQ EYNTPPTFGGGTKVEIKRTVAAPSVFIFPPSDEQLKSGTASVVCL LNNFYPREAKVQWKVDNALQSGNSQESVTEQDSKDSTYSLSST LTLSKADYEKHKVYACEVTHQGLSSPVTKSFNRGEC |
| 39 | ABP75 | Full Light | DIQMTQSPSSLSASVGDRVTITCRASQSISSYLNWYQQKPGKAP KLLIYAADSLQSGVPSRFSGSGSGTDFTLTISSLQPEDFATYYCQ QEYNTPPTFGGGTKVEIKRTVAAPSVFIFPPSDEQLKSGTASVVC LLNNFYPREAKVQWKVDNALQSGNSQESVTEQDSKDSTYSLSS TLTLSKADYEKHKVYACEVTHQGLSSPVTKSFNRGEC |
| 43 | ABP76 | Full Light | DIQMTQSPSSLSASVGDRVTITCRASQSINSYLNWYQQKPGKAP KLLIYAASSLDSGVPSRFSGSGSGTDFTLTISSLQPEDFATYYCQQ EYNTPPTFGGGTKVEIKRTVAAPSVFIFPPSDEQLKSGTASVVCL LNNFYPREAKVQWKVDNALQSGNSQESVTEQDSKDSTYSLSST LTLSKADYEKHKVYACEVTHQGLSSPVTKSFNRGEC |

APPENDIX A-continued

SEQUENCES

| SEQ ID NO | Molecule | Description | SEQUENCE |
|---|---|---|---|
| 52 | ABP77 | Full Light | DIQMTQSPSSLSASVGDRVTITCGASQSISTYLNWYQQKPGKAP KLLIYSASSLESGVPSRFSGSGSGTDFTLTISSLQPEDFATYYCQQ EYNTPPSFGGGTKVEIKRTVAAPSVFIFPPSDEQLKSGTASVVCL LNNFYPREAKVQWKVDNALQSGNSQESVTEQDSKDSTYSLSST LTLSKADYEKHKVYACEVTHQGLSSPVTKSFNRGEC |
| 107 | ABP78 | Full Light | DIVMTQSPLSLPVTPGEPASISCRSSQSLLHSNGYNYLDWYLQKP GQSPQLLIYLGSNRASGVPDRFSGSGSGTDFTLKISRVEAEDVGV YYCMQKIGTPLTFGGGTKVEIKRTVAAPSVFIFPPSDEQLKSGTA SVVCLLNNFYPREAKVQWKVDNALQSGNSQESVTEQDSKDSTY SLSSTLTLSKADYEKHKVYACEVTHQGLSSPVTKSFNRGEC |
| 107 | ABP79 | Full Light | DIVMTQSPLSLPVTPGEPASISCRSSQSLLHSNGYNYLDWYLQKP GQSPQLLIYLGSNRASGVPDRFSGSGSGTDFTLKISRVEAEDVGV YYCMQKIGTPLTFGGGTKVEIKRTVAAPSVFIFPPSDEQLKSGTA SVVCLLNNFYPREAKVQWKVDNALQSGNSQESVTEQDSKDSTY SLSSTLTLSKADYEKHKVYACEVTHQGLSSPVTKSFNRGEC |
| 109 | ABP80 | Full Light | DIQLTQSPSSVSASVGDRVTITCRASQGISSWLAWYQQKPGKAP KLLIYGASSLQSGVPSRFSGSGSGTDFTLTISSLQPEDFATYYCQQ ASLFPPTFGGGTKVEIKRTVAAPSVFIFPPSDEQLKSGTASVVCLL NNFYPREAKVQWKVDNALQSGNSQESVTEQDSKDSTYSLSSTL TLSKADYEKHKVYACEVTHQGLSSPVTKSFNRGEC |
| 111 | ABP81 | Full Light | EIVLTQSPATLSLSPGERATLSCRASQSVSSYLAWYQQKPGQAP RLLIYDASNRATGIPARFSGSGSGTDFTLTISSLEPEDFAVYYCQQ RLVFPPTFGGGTKVEIKRTVAAPSVFIFPPSDEQLKSGTASVVCL LNNFYPREAKVQWKVDNALQSGNSQESVTEQDSKDSTYSLSST LTLSKADYEKHKVYACEVTHQGLSSPVTKSFNRGEC |
| 111 | ABP82 | Full Light | EIVLTQSPATLSLSPGERATLSCRASQSVSSYLAWYQQKPGQAP RLLIYDASNRATGIPARFSGSGSGTDFTLTISSLEPEDFAVYYCQQ RLVFPPTFGGGTKVEIKRTVAAPSVFIFPPSDEQLKSGTASVVCL LNNFYPREAKVQWKVDNALQSGNSQESVTEQDSKDSTYSLSST LTLSKADYEKHKVYACEVTHQGLSSPVTKSFNRGEC |
| 111 | ABP83 | Full Light | EIVLTQSPATLSLSPGERATLSCRASQSVSSYLAWYQQKPGQAP RLLIYDASNRATGIPARFSGSGSGTDFTLTISSLEPEDFAVYYCQQ RLVFPPTFGGGTKVEIKRTVAAPSVFIFPPSDEQLKSGTASVVCL LNNFYPREAKVQWKVDNALQSGNSQESVTEQDSKDSTYSLSST LTLSKADYEKHKVYACEVTHQGLSSPVTKSFNRGEC |
| 113 | ABP84 | Full Light | EIVLTQSPATLSLSPGERATLSCRASQSVSSYLAWYQQKPGQAP RLLIYDASNRATGIPARFSGSGSGTDFTLTISSLEPEDFAVYYCQQ HSVFPPTFGGGTKVEIKRTVAAPSVFIFPPSDEQLKSGTASVVCL LNNFYPREAKVQWKVDNALQSGNSQESVTEQDSKDSTYSLSST LTLSKADYEKHKVYACEVTHQGLSSPVTKSFNRGEC |
| 113 | ABP85 | Full Light | EIVLTQSPATLSLSPGERATLSCRASQSVSSYLAWYQQKPGQAP RLLIYDASNRATGIPARFSGSGSGTDFTLTISSLEPEDFAVYYCQQ HSVFPPTFGGGTKVEIKRTVAAPSVFIFPPSDEQLKSGTASVVCL LNNFYPREAKVQWKVDNALQSGNSQESVTEQDSKDSTYSLSST LTLSKADYEKHKVYACEVTHQGLSSPVTKSFNRGEC |
| 107 | ABP86 | Full Light | DIVMTQSPLSLPVTPGEPASISCRSSQSLLHSNGYNYLDWYLQKP GQSPQLLIYLGSNRASGVPDRFSGSGSGTDFTLKISRVEAEDVGV YYCMQKIGTPLTFGGGTKVEIKRTVAAPSVFIFPPSDEQLKSGTA SVVCLLNNFYPREAKVQWKVDNALQSGNSQESVTEQDSKDSTY SLSSTLTLSKADYEKHKVYACEVTHQGLSSPVTKSFNRGEC |
| 107 | ABP87 | Full Light | DIVMTQSPLSLPVTPGEPASISCRSSQSLLHSNGYNYLDWYLQKP GQSPQLLIYLGSNRASGVPDRFSGSGSGTDFTLKISRVEAEDVGV YYCMQKIGTPLTFGGGTKVEIKRTVAAPSVFIFPPSDEQLKSGTA SVVCLLNNFYPREAKVQWKVDNALQSGNSQESVTEQDSKDSTY SLSSTLTLSKADYEKHKVYACEVTHQGLSSPVTKSFNRGEC |
| 109 | ABP88 | Full Light | DIQLTQSPSSVSASVGDRVTITCRASQGISSWLAWYQQKPGKAP KLLIYGASSLQSGVPSRFSGSGSGTDFTLTISSLQPEDFATYYCQQ ASLFPPTFGGGTKVEIKRTVAAPSVFIFPPSDEQLKSGTASVVCLL NNFYPREAKVQWKVDNALQSGNSQESVTEQDSKDSTYSLSSTL TLSKADYEKHKVYACEVTHQGLSSPVTKSFNRGEC |

APPENDIX A-continued

SEQUENCES

| SEQ ID NO | Molecule | Description | SEQUENCE |
|---|---|---|---|
| 111 | ABP89 | Full Light | EIVLTQSPATLSLSPGERATLSCRASQSVSSYLAWYQQKPGQAP RLLIYDASNRATGIPARFSGSGSGTDFTLTISSLEPEDFAVYYCQQ RLVFPPTFGGGTKVEIKRTVAAPSVFIFPPSDEQLKSGTASVVCL LNNFYPREAKVQWKVDNALQSGNSQESVTEQDSKDSTYSLSST LTLSKADYEKHKVYACEVTHQGLSSPVTKSFNRGEC |
| 111 | ABP90 | Full Light | EIVLTQSPATLSLSPGERATLSCRASQSVSSYLAWYQQKPGQAP RLLIYDASNRATGIPARFSGSGSGTDFTLTISSLEPEDFAVYYCQQ RLVFPPTFGGGTKVEIKRTVAAPSVFIFPPSDEQLKSGTASVVCL LNNFYPREAKVQWKVDNALQSGNSQESVTEQDSKDSTYSLSST LTLSKADYEKHKVYACEVTHQGLSSPVTKSFNRGEC |
| 111 | ABP91 | Full Light | EIVLTQSPATLSLSPGERATLSCRASQSVSSYLAWYQQKPGQAP RLLIYDASNRATGIPARFSGSGSGTDFTLTISSLEPEDFAVYYCQQ RLVFPPTFGGGTKVEIKRTVAAPSVFIFPPSDEQLKSGTASVVCL LNNFYPREAKVQWKVDNALQSGNSQESVTEQDSKDSTYSLSST LTLSKADYEKHKVYACEVTHQGLSSPVTKSFNRGEC |
| 113 | ABP92 | Full Light | EIVLTQSPATLSLSPGERATLSCRASQSVSSYLAWYQQKPGQAP RLLIYDASNRATGIPARFSGSGSGTDFTLTISSLEPEDFAVYYCQQ HSVFPPTFGGGTKVEIKRTVAAPSVFIFPPSDEQLKSGTASVVCL LNNFYPREAKVQWKVDNALQSGNSQESVTEQDSKDSTYSLSST LTLSKADYEKHKVYACEVTHQGLSSPVTKSFNRGEC |
| 113 | ABP93 | Full Light | EIVLTQSPATLSLSPGERATLSCRASQSVSSYLAWYQQKPGQAP RLLIYDASNRATGIPARFSGSGSGTDFTLTISSLEPEDFAVYYCQQ HSVFPPTFGGGTKVEIKRTVAAPSVFIFPPSDEQLKSGTASVVCL LNNFYPREAKVQWKVDNALQSGNSQESVTEQDSKDSTYSLSST LTLSKADYEKHKVYACEVTHQGLSSPVTKSFNRGEC |
| 222 | ABP94 | Full Heavy | QVQLQESGPGLVKPSETLSLTCAVSGYSISSGLGWGWIRQPPGK GLEWIGGIYESGSTYYNPSLKSRVTISVDTSKNQFSLKLSSVTAA DTAVYYCAHERVRGYGDYGGHHAFDIWGQGTMVTVSSASTKG PSVFPLAPCSRSTSESTAALGCLVKDYFPEPVTVSWNSGALTSGV HTFPAVLQSSGLYSLSSVVTVPSSSLGTKTYTCNVDHKPSNTKV DKRVESKYGPPCPPCPAPEFLGGPSVFLFPPKPKDTLMISRTPEVT CVVVDVSQEDPEVQFNWYVDGVEVHNAKTKPREEQFNSTYRV VSVLTVLHQDWLNGKEYKCKVSNKGLPSSIEKTISKAKGQPREP QVYTLPPSQEEMTKNQVSLTCLVKGFYPSDIAVEWESNGQPEN NYKTTPPVLDSDGSFFLYSRLTVDKSRWQEGNVFSCSVMHEAL HNHYTQKSLSLSLGKGGGGSQVQLQESGPGLVKPSETLSLTCAV SGYSISSGLGWGWIRQPPGKGLEWIGGIYESGSTYYNPSLKSRVT ISVDTSKNQFSLKLSSVTAADTAVYYCAHERVRGYGDYGGHHA FDIWGQGTMVTVSSASTKGPSVFPLAPSSKSTSGGTAALGCLVK DYFPEPVTVSWNSGALTSGVHTFPAVLQSSGLYSLSSVVTVPSSS LGTQTYICNVNHKPSNTKVDKRVEPKSC |
| 223 | ABP95 | Full Heavy | QVQLQESGPGLVKPSQTLSLTCTVSGGSISSGGAVVVSWIRQHPG KGLEWIGGIAYSGSTYYNPSLKSRVTISVDTSKNQFSLKLSSVTA ADTAVYYCADENVRGYGDYGGHHAFDIWGQGTMVTVSSAST KGPSVFPLAPCSRSTSESTAALGCLVKDYFPEPVTVSWNSGALTS GVHTFPAVLQSSGLYSLSSVVTVPSSSLGTKTYTCNVDHKPSNT KVDKRVESKYGPPCPPCPAPEFLGGPSVFLFPPKPKDTLMISRTP EVTCVVVDVSQEDPEVQFNWYVDGVEVHNAKTKPREEQFNST YRVVSVLTVLHQDWLNGKEYKCKVSNKGLPSSIEKTISKAKGQ PREPQVYTLPPSQEEMTKNQVSLTCLVKGFYPSDIAVEWESNGQ PENNYKTTPPVLDSDGSFFLYSRLTVDKSRWQEGNVFSCSVMH EALHNHYTQKSLSLSLGKGGGGSQVQLQESGPGLVKPSQTLSLT CTVSGGSISSGGAVVVSWIRQHPGKGLEWIGGIAYSGSTYYNPSL KSRVTISVDTSKNQFSLKLSSVTAADTAVYYCADENVRGYGDY GGHHAFDIWGQGTMVTVSSASTKGPSVFPLAPSSKSTSGGTAAL GCLVKDYFPEPVTVSWNSGALTSGVHTFPAVLQSSGLYSLSSVV TVPSSSLGTQTYICNVNHKPSNTKVDKRVEPKSC |
| 224 | ABP96 | Full Heavy | QVQLQESGPGLVKPSETLSLTCAVSGYSISSGAGWGWIRQPPGK GLEWIGLIVHSGSTYYNPSLKSRVTISVDTSKNQFSLKLSSVTAA DTAVYYCVLESVRGYGDYGGHHAFDIWGQGTMVTVSSASTKG PSVFPLAPCSRSTSESTAALGCLVKDYFPEPVTVSWNSGALTSGV HTFPAVLQSSGLYSLSSVVTVPSSSLGTKTYTCNVDHKPSNTKV DKRVESKYGPPCPPCPAPEFLGGPSVFLFPPKPKDTLMISRTPEVT CVVVDVSQEDPEVQFNWYVDGVEVHNAKTKPREEQFNSTYRV VSVLTVLHQDWLNGKEYKCKVSNKGLPSSIEKTISKAKGQPREP QVYTLPPSQEEMTKNQVSLTCLVKGFYPSDIAVEWESNGQPEN |

APPENDIX A-continued

SEQUENCES

| SEQ ID NO | Molecule | Description | SEQUENCE |
|---|---|---|---|
| | | | NYKTTPPVLDSDGSFFLYSRLTVDKSRWQEGNVFSCSVMHEAL HNHYTQKSLSLSLGKGGGGSQVQLQESGPGLVKPSETLSLTCAV SGYSISSGAGWGWIRQPPGKGLEWIGLIVHSGSTYYNPSLKSRV TISVDTSKNQFSLKLSSVTAADTAVYYCVLESVRGYGDYGGHH AFDIWGQGTMVTVSSASTKGPSVFPLAPSSKSTSGGTAALGCLV KDYFPEPVTVSWNSGALTSGVHTFPAVLQSSGLYSLSSVVTVPS SSLGTQTYICNVNHKPSNTKVDKRVEPKSC |
| 225 | ABP97 | Full Heavy | QVQLQESGPGLVKPSETLSLTCAVSGYSISSGAGWGWIRQPPGK GPEWIGLIVHSGSTYYNPSLKSRVTISVDTSKNQFSLKLSSVTAA DTAVYYCVLESVRGYGDYGGHHAFDIWGQGTMVTVSSASTKG PSVFPLAPCSRSTSESTAALGCLVKDYFPEPVTVSWNSGALTSGV HTFPAVLQSSGLYSLSSVVTVPSSSLGTKTYTCNVDHKPSNTKV DKRVESKYGPPCPPCPAPEFLGGPSVFLFPPKPKDTLMISRTPEVT CVVVDVSQEDPEVQFNWYVDGVEVHNAKTKPREEQFNSTYRV VSVLTVLHQDWLNGKEYKCKVSNKGLPSSIEKTISKAKGQPREP QVYTLPPSQEEMTKNQVSLTCLVKGFYPSDIAVEWESNGQPEN NYKTTPPVLDSDGSFFLYSRLTVDKSRWQEGNVFSCSVMHEAL HNHYTQKSLSLSLGKGGGGSQVQLQESGPGLVKPSETLSLTCAV SGYSISSGAGWGWIRQPPGKGPEWIGLIVHSGSTYYNPSLKSRVT ISVDTSKNQFSLKLSSVTAADTAVYYCVLESVRGYGDYGGHHA FDIWGQGTMVTVSSASTKGPSVFPLAPSSKSTSGGTAALGCLVK DYFPEPVTVSWNSGALTSGVHTFPAVLQSSGLYSLSSVVTVPSSS LGTQTYICNVNHKPSNTKVDKRVEPKSC |
| 226 | ABP98 | Full Heavy | QVQLQESGPGLVKPSETLSLTCAVSGYSISSGAGWGWIRQPPGK GLEWIGLIVHSGSTYYNPSLKSRVTISVDTSKNQFSLKLSSVTAA DTAVYYCVLESVRGYGDYGGHHAFDIWGQGTMVTVSSASTKG PSVFPLAPCSRSTSESTAALGCLVKDYFPEPVTVSWNSGALTSGV HTFPAVLQSSGLYSLSSVVTVPSSSLGTKTYTCNVDHKPSNTKV DKRVESKYGPPCPPCPAPEFLGGPSVFLFPPKPKDTLMISRTPEVT CVVVDVSQEDPEVQFNWYVDGVEVHNAKTKPREEQFNSTYRV VSVLTVLHQDWLNGKEYKCKVSNKGLPSSIEKTISKAKGQPREP QVYTLPPSQEEMTKNQVSLTCLVKGFYPSDIAVEWESNGQPEN NYKTTPPVLDSDGSFFLYSRLTVDKSRWQEGNVFSCSVMHEAL HNHYTQKSLSLSLGKGGGGSQVQLQESGPGLVKPSETLSLTCAV SGYSISSGAGWGWIRQPPGKGLEWIGLIVHSGSTYYNPSLKSRV TISVDTSKNQFSLKLSSVTAADTAVYYCVLESVRGYGDYGGHH AFDIWGQGTMVTVSSASTKGPSVFPLAPSSKSTSGGTAALGCLV KDYFPEPVTVSWNSGALTSGVHTFPAVLQSSGLYSLSSVVTVPS SSLGTQTYICNVNHKPSNTKVDKRVEPKSC |
| 227 | ABP99 | Full Heavy | QVQLQESGPGLVKPSETLSLTCAVSGYSISSGAGWGWIRQPPGK GLEWIGLIVHSGSTYYNPSLKSRVTISVDTSKNQFSLKLSSVTAA DTAVYYCVLESVRGYGDYGGHHAFDIWGQGTMVTVSSASTKG PSVFPLAPCSRSTSESTAALGCLVKDYFPEPVTVSWNSGALTSGV HTFPAVLQSSGLYSLSSVVTVPSSSLGTKTYTCNVDHKPSNTKV DKRVESKYGPPCPPCPAPEFLGGPSVFLFPPKPKDTLMISRTPEVT CVVVDVSQEDPEVQFNWYVDGVEVHNAKTKPREEQFNSTYRV VSVLTVLHQDWLNGKEYKCKVSNKGLPSSIEKTISKAKGQPREP QVYTLPPSQEEMTKNQVSLTCLVKGFYPSDIAVEWESNGQPEN NYKTTPPVLDSDGSFFLYSRLTVDKSRWQEGNVFSCSVMHEAL HNHYTQKSLSLSLGKGGGGSQVQLQESGPGLVKPSETLSLTCAV SGYSISSGAGWGWIRQPPGKGLEWIGLIVHSGSTYYNPSLKSRV TISVDTSKNQFSLKLSSVTAADTAVYYCVLESVRGYGDYGGHH AFDIWGQGTMVTVSSASTKGPSVFPLAPSSKSTSGGTAALGCLV KDYFPEPVTVSWNSGALTSGVHTFPAVLQSSGLYSLSSVVTVPS SSLGTQTYICNVNHKPSNTKVDKRVEPKSC |
| 228 | ABP100 | Full Heavy | QVQLQESGPGLVKPSETLSLTCAVSGYSISSEYMVVGWI RQPPGKGLEWIGLIYHSGKTYYNPSLKSRVTISVDTSKNQFSLKL SSVTAADTAVYYCAREADRGYGDYGGHHAFDIWGQGTMVTVS SASTKGPSVFPLAPCSRSTSESTAALGCLVKDYFPEPVTVSWNSG ALTSGVHTFPAVLQSSGLYSLSSVVTVPSSSLGTKTYTCNVDHK PSNTKVDKRVESKYGPPCPPCPAPEFLGGPSVFLFPPKPKDTLMI SRTPEVTCVVVDVSQEDPEVQFNWYVDGVEVHNAKTKPREEQF NSTYRVVSVLTVLHQDWLNGKEYKCKVSNKGLPSSIEKTISKAK GQPREPQVYTLPPSQEEMTKNQVSLTCLVKGFYPSDIAVEWESN GQPENNYKTTPPVLDSDGSFFLYSRLTVDKSRWQEGNVFSCSV MHEALHNHYTQKSLSLSLGKGGGGSQVQLQESGPGLVKPSETL SLTCAVSGYSISSEYMWGWIRQPPGKGLEWIGLIYHSGKTYYNP SLKSRVTISVDTSKNQFSLKLSSVTAADTAVYYCAREADRGYGD |

APPENDIX A-continued

SEQUENCES

| SEQ ID NO | Molecule | Description | SEQUENCE |
|---|---|---|---|
| | | | YGGHHAFDIWGQGTMVTVSSASTKGPSVFPLAPSSKSTSGGTAA LGCLVKDYFPEPVTVSWNSGALTSGVHTFPAVLQSSGLYSLSSV VTVPSSSLGTQTYICNVNHKPSNTKVDKRVEPKSC |
| 229 | ABP101 | Full Heavy | QVQLQESGPGLVKPSETLSLTCAVSGYSISSEYMWGWIRQPPGK GLEWIGLIYHSGKTYYNPSLKSRVTISVDTSKNQFSLKLSSVTAA DTAVYYCAREADRGYGDYGGHHAFDIWGQGTMVTVSSASTKG PSVFPLAPCSRSTSESTAALGCLVKDYFPEPVTVSWNSGALTSGV HTFPAVLQSSGLYSLSSVVTVPSSSLGTKTYTCNVDHKPSNTKV DKRVESKYGPPCPPCPAPEFLGGPSVFLFPPKPKDTLMISRTPEVT CVVVDVSQEDPEVQFNWYVDGVEVHNAKTKPREEQFNSTYRV VSVLTVLHQDWLNGKEYKCKVSNKGLPSSIEKTISKAKGQPREP QVYTLPPSQEEMTKNQVSLTCLVKGFYPSDIAVEWESNGQPEN NYKTTPPVLDSDGSFFLYSRLTVDKSRWQEGNVFSCSVMHEAL HNHYTQKSLSLSLGKGGGSQVQLQESGPGLVKPSETLSLTCAV SGYSISSEYMWGWIRQPPGKGLEWIGLIYHSGKTYYNPSLKSRV TISVDTSKNQFSLKLSSVTAADTAVYYCAREADRGYGDYGGHH AFDIWGQGTMVTVSSASTKGPSVFPLAPSSKSTSGGTAALGCLV KDYFPEPVTVSWNSGALTSGVHTFPAVLQSSGLYSLSSVVTVPS SSLGTQTYICNVNHKPSNTKVDKRVEPKSC |
| 230 | ABP102 | Full Heavy | QVQLVQSGAEVKRPGSSVKVSCKASGGTFSSYYISWVRQVPGQ GLEWMGGIIPVPGTANYAQKFQGRVTITADESTSTAYMELSSLR SEDTAVYYCARAGGGYARGDHYYGMDVVVGQGTTVTVSSAST KGPSVFPLAPCSRSTSESTAALGCLVKDYFPEPVTVSWNSGALTS GVHTFPAVLQSSGLYSLSSVVTVPSSSLGTKTYTCNVDHKPSNT KVDKRVESKYGPPCPPCPAPEFLGGPSVFLFPPKPKDTLMISRTP EVTCVVVDVSQEDPEVQFNWYVDGVEVHNAKTKPREEQFNST YRVVSVLTVLHQDWLNGKEYKCKVSNKGLPSSIEKTISKAKGQ PREPQVYTLPPSQEEMTKNQVSLTCLVKGFYPSDIAVEWESNGQ PENNYKTTPPVLDSDGSFFLYSRLTVDKSRWQEGNVFSCSVMH EALHNHYTQKSLSLSLGKGGGSQVQLVQSGAEVKRPGSSVKV SCKASGGTFSSYYISWVRQVPGQGLEWMGGIIPVPGTANYAQK FQGRVTITADESTSTAYMELSSLRSEDTAVYYCARAGGGYARG DHYYGMDVVVGQGTTVTVSSASTKGPSVFPLAPSSKSTSGGTAA LGCLVKDYFPEPVTVSWNSGALTSGVHTFPAVLQSSGLYSLSSV VTVPSSSLGTQTYICNVNHKPSNTKVDKRVEPKSC |
| 231 | ABP103 | Full Heavy | QVQLVQSGAEVKKPGSSVKVSCKASGGTFSSYYISWVRQAPGQ RLEWMGGIIPVPGTANYAQKFQGRVTITADESTSTAYMELSSLR SEDTAVYYCARAGGGYARGDHYYGMDVVVGQGTTVTVSSAST KGPSVFPLAPCSRSTSESTAALGCLVKDYFPEPVTVSWNSGALTS GVHTFPAVLQSSGLYSLSSVVTVPSSSLGTKTYTCNVDHKPSNT KVDKRVESKYGPPCPPCPAPEFLGGPSVFLFPPKPKDTLMISRTP EVTCVVVDVSQEDPEVQFNWYVDGVEVHNAKTKPREEQFNST YRVVSVLTVLHQDWLNGKEYKCKVSNKGLPSSIEKTISKAKGQ PREPQVYTLPPSQEEMTKNQVSLTCLVKGFYPSDIAVEWESNGQ PENNYKTTPPVLDSDGSFFLYSRLTVDKSRWQEGNVFSCSVMH EALHNHYTQKSLSLSLGKGGGSQVQLVQSGAEVKKPGSSVKV SCKASGGTFSSYYISWVRQAPGQRLEWMGGIIPVPGTANYAQKF QGRVTITADESTSTAYMELSSLRSEDTAVYYCARAGGGYARGD HYYGMDVVVGQGTTVTVSSASTKGPSVFPLAPSSKSTSGGTAAL GCLVKDYFPEPVTVSWNSGALTSGVHTFPAVLQSSGLYSLSSVV TVPSSSLGTQTYICNVNHKPSNTKVDKRVEPKSC |
| 232 | ABP104 | Full Heavy | QVQLVQSGAEVKKPGSSVKVSCKASGGTFSRGAISWVRQAPGQ GLEWMGGIIPIEGTAYYAQKFQGRVTITADESTGTAYMELSSLR SEDTAVYYCARQSDYGLPRGMDVVVGQGTTVTVSSASTKGPSV FPLAPCSRSTSESTAALGCLVKDYFPEPVTVSWNSGALTSGVHT FPAVLQSSGLYSLSSVVTVPSSSLGTKTYTCNVDHKPSNTKVDK RVESKYGPPCPPCPAPEFLGGPSVFLFPPKPKDTLMISRTPEVTCV VVDVSQEDPEVQFNWYVDGVEVHNAKTKPREEQFNSTYRVVS VLTVLHQDWLNGKEYKCKVSNKGLPSSIEKTISKAKGQPREPQV YTLPPSQEEMTKNQVSLTCLVKGFYPSDIAVEWESNGQPENNY KTTPPVLDSDGSFFLYSRLTVDKSRWQEGNVFSCSVMHEALHN HYTQKSLSLSLGKGGGSQVQLVQSGAEVKKPGSSVKVSCKAS GGTFSRGAISWVRQAPGQGLEWMGGIIPIEGTAYYAQKFQGRV TITADESTGTAYMELSSLRSEDTAVYYCARQSDYGLPRGMDVVV GQGTTVTVSSASTKGPSVFPLAPSSKSTSGGTAALGCLVKDYFP EPVTVSWNSGALTSGVHTFPAVLQSSGLYSLSSVVTVPSSSLGT QTYICNVNHKPSNTKVDKRVEPKSC |
| 233 | ABP105 | Full Heavy | QVQLVQSGAEVKKPGSSVKVSCKASGGTFSSYAISWVRQAPGQ GLEWMGGIIPISGFTNYAQKFQGRVTITADESTSTAYMELSSLRS |

APPENDIX A-continued

SEQUENCES

| SEQ ID NO | Molecule | Description | SEQUENCE |
|---|---|---|---|
| | | | EDTAVYYCAREGGHYYSGWPYWGQGTLVTVSSASTKGPSVFP<br>LAPCSRSTSESTAALGCLVKDYFPEPVTVSWNSGALTSGVHTFP<br>AVLQSSGLYSLSSVVTVPSSSLGTKTYTCNVDHKPSNTKVDKRV<br>ESKYGPPCPPCPAPEFLGGPSVFLFPPKPKDTLMISRTPEVTCVVV<br>DVSQEDPEVQFNWYVDGVEVHNAKTKPREEQFNSTYRVVSVL<br>TVLHQDWLNGKEYKCKVSNKGLPSSIEKTISKAKGQPREPQVYT<br>LPPSQEEMTKNQVSLTCLVKGFYPSDIAVEWESNGQPENNYKTT<br>PPVLDSDGSFFLYSRLTVDKSRWQEGNVFSCSVMHEALHNHYT<br>QKSLSLSLGKGGGGSQVQLVQSGAEVKKPGSSVKVSCKASGGT<br>FSSYAISWVRQAPGQGLEWMGGIIPISGFTNYAQKFQGRVTITA<br>DESTSTAYMELSSLRSEDTAVYYCAREGGHYYSGWPYWGQGT<br>LVTVSSASTKGPSVFPLAPSSKSTSGGTAALGCLVKDYFPEPVTV<br>SWNSGALTSGVHTFPAVLQSSGLYSLSSVVTVPSSSLGTQTYICN<br>VNHKPSNTKVDKRVEPKSC |
| 216 | ABP106 | Full Heavy | QVQLVQSGAEVKKPGSSVKVSCKASGGTFSSYAISWVRQAPGQ<br>RLEWMGGIIPISGFTNYAQKFQGRVTITADESTSTAYMELSSLRS<br>EDTAVYYCAREGGHYYSGWPYWGQGTLVTVSSASTKGPSVFP<br>LAPCSRSTSESTAALGCLVKDYFPEPVTVSWNSGALTSGVHTFP<br>AVLQSSGLYSLSSVVTVPSSSLGTKTYTCNVDHKPSNTKVDKRV<br>ESKYGPPCPPCPAPEFLGGPSVFLFPPKPKDTLMISRTPEVTCVVV<br>DVSQEDPEVQFNWYVDGVEVHNAKTKPREEQFNSTYRVVSVL<br>TVLHQDWLNGKEYKCKVSNKGLPSSIEKTISKAKGQPREPQVYT<br>LPPSQEEMTKNQVSLTCLVKGFYPSDIAVEWESNGQPENNYKTT<br>PPVLDSDGSFFLYSRLTVDKSRWQEGNVFSCSVMHEALHNHYT<br>QKSLSLSLGKGGGGSQVQLVQSGAEVKKPGSSVKVSCKASGGT<br>FSSYAISWVRQAPGQRLEWMGGIIPISGFTNYAQKFQGRVTITAD<br>ESTSTAYMELSSLRSEDTAVYYCAREGGHYYSGWPYWGQGTL<br>VTVSSASTKGPSVFPLAPSSKSTSGGTAALGCLVKDYFPEPVTVS<br>WNSGALTSGVHTFPAVLQSSGLYSLSSVVTVPSSSLGTQTYICN<br>VNHKPSNTKVDKRVEPKSC |
| 217 | ABP107 | Full Heavy | QVQLVQSGAEVKKPGSSVKVSCKASGGTFSSYAISWVRQAPGQ<br>GLEWMGGIIPISGFTNYAQKFQGKVTITADESTSTAYMELSSLRS<br>EDTAVYYCAREGGHYYSGWPYWGQGTLVTVSSASTKGPSVFP<br>LAPCSRSTSESTAALGCLVKDYFPEPVTVSWNSGALTSGVHTFP<br>AVLQSSGLYSLSSVVTVPSSSLGTKTYTCNVDHKPSNTKVDKRV<br>ESKYGPPCPPCPAPEFLGGPSVFLFPPKPKDTLMISRTPEVTCVVV<br>DVSQEDPEVQFNWYVDGVEVHNAKTKPREEQFNSTYRVVSVL<br>TVLHQDWLNGKEYKCKVSNKGLPSSIEKTISKAKGQPREPQVYT<br>LPPSQEEMTKNQVSLTCLVKGFYPSDIAVEWESNGQPENNYKTT<br>PPVLDSDGSFFLYSRLTVDKSRWQEGNVFSCSVMHEALHNHYT<br>QKSLSLSLGKGGGGSQVQLVQSGAEVKKPGSSVKVSCKASGGT<br>FSSYAISWVRQAPGQGLEWMGGIIPISGFTNYAQKFQGKVTITA<br>DESTSTAYMELSSLRSEDTAVYYCAREGGHYYSGWPYWGQGT<br>LVTVSSASTKGPSVFPLAPSSKSTSGGTAALGCLVKDYFPEPVTV<br>SWNSGALTSGVHTFPAVLQSSGLYSLSSVVTVPSSSLGTQTYICN<br>VNHKPSNTKVDKRVEPKSC |
| 218 | ABP108 | Full Heavy | QVQLVQSGAEVKKPGSSVKVSCKASGGTFVRYAISWVRQAPGQ<br>GLEWMGGIIPIFGEAQYAQRFQGRVTITADESTSTAYMELSSLRS<br>EDTAVYYCAREGYYYGALPYWGQGTLVTVSSASTKGPSVFPLA<br>PCSRSTSESTAALGCLVKDYFPEPVTVSWNSGALTSGVHTFPAV<br>LQSSGLYSLSSVVTVPSSSLGTKTYTCNVDHKPSNTKVDKRVES<br>KYGPPCPPCPAPEFLGGPSVFLFPPKPKDTLMISRTPEVTCVVVD<br>VSQEDPEVQFNWYVDGVEVHNAKTKPREEQFNSTYRVVSVLT<br>VLHQDWLNGKEYKCKVSNKGLPSSIEKTISKAKGQPREPQVYTL<br>PPSQEEMTKNQVSLTCLVKGFYPSDIAVEWESNGQPENNYKTTP<br>PVLDSDGSFFLYSRLTVDKSRWQEGNVFSCSVMHEALHNHYTQ<br>KSLSLSLGKGGGGSQVQLVQSGAEVKKPGSSVKVSCKASGGTF<br>VRYAISWVRQAPGQGLEWMGGIIPIFGEAQYAQRFQGRVTITAD<br>ESTSTAYMELSSLRSEDTAVYYCAREGYYYGALPYWGQGTLVT<br>VSSASTKGPSVFPLAPSSKSTSGGTAALGCLVKDYFPEPVTVSW<br>NSGALTSGVHTFPAVLQSSGLYSLSSVVTVPSSSLGTQTYICNVN<br>HKPSNTKVDKRVEPKSC |
| 219 | ABP109 | Full Heavy | QVQLVQSGAEVKKPGSSVKVSCKASGGTFVRYAISWVRQAPGQ<br>GLEWMGGIIPIFGEAQYAQKFRGRATITADESTSTAYMELSSLRS<br>EDTAVYYCAREGYYYGALPYWGQGTLVTVSSASTKGPSVFPLA<br>PCSRSTSESTAALGCLVKDYFPEPVTVSWNSGALTSGVHTFPAV<br>LQSSGLYSLSSVVTVPSSSLGTKTYTCNVDHKPSNTKVDKRVES<br>KYGPPCPPCPAPEFLGGPSVFLFPPKPKDTLMISRTPEVTCVVVD<br>VSQEDPEVQFNWYVDGVEVHNAKTKPREEQFNSTYRVVSVLT<br>VLHQDWLNGKEYKCKVSNKGLPSSIEKTISKAKGQPREPQVYTL |

APPENDIX A-continued

SEQUENCES

| SEQ ID NO | Molecule | Description | SEQUENCE |
|---|---|---|---|
|  |  |  | PPSQEEMTKNQVSLTCLVKGFYPSDIAVEWESNGQPENNYKTTP PVLDSDGSFFLYSRLTVDKSRWQEGNVFSCSVMHEALHNHYTQ KSLSLSLGKGGGGSQVQLVQSGAEVKKPGSSVKVSCKASGGTF VRYAISWVRQAPGQGLEWMGGIIPIFGEAQYAQKFRGRATITAD ESTSTAYMELSSLRSEDTAVYYCAREGYYYGALPYWGQGTLVT VSSASTKGPSVFPLAPSSKSTSGGTAALGCLVKDYFPEPVTVSW NSGALTSGVHTFPAVLQSSGLYSLSSVVTVPSSSLGTQTYICNVN HKPSNTKVDKRVEPKSC |
| 8 | ABP94 | Full Light | DIQMTQSPSSLSASVGDRVTITCRASQSISSYLNWYQQKPGKAP KLLIYAASSLQSGVPSRFSGSGSGTDFTLTISSLQPEDFATYYCQQ EYATPPTFGGGTKVEIKRTVAAPSVFIFPPSDEQLKSGTASVVCL LNNFYPREAKVQWKVDNALQSGNSQESVTEQDSKDSTYSLSST LTLSKADYEKHKVYACEVTHQGLSSPVTKSFNRGEC |
| 18 | ABP95 | Full Light | DIQMTQSPSSLSASVGDRVTITCRASQSISSYLNWYQQKPGKAP KLLIYAASSLQSGVPSRFSGSGSGTDFTLTISSLQPEDFATYYCQQ EYNTPPTFGGGTKVEIKRTVAAPSVFIFPPSDEQLKSGTASVVCL LNNFYPREAKVQWKVDNALQSGNSQESVTEQDSKDSTYSLSST LTLSKADYEKHKVYACEVTHQGLSSPVTKSFNRGEC |
| 25 | ABP96 | Full Light | DIQMTQSPSSLSASVGDRVTITCRASQSISSYLNWYQQKPGKAP KLLIYAASSLKYGVPSRFSGSGSGTDFTLTISSLQPEDFATYYCQ QEYNTPPTFGGGTKVEIKRTVAAPSVFIFPPSDEQLKSGTASVVC LLNNFYPREAKVQWKVDNALQSGNSQESVTEQDSKDSTYSLSS TLTLSKADYEKHKVYACEVTHQGLSSPVTKSFNRGEC |
| 33 | ABP97 | Full Light | DIQMTQSPSSLSASVGDRVTITCRASKSIDSYLNWYQQKPGKAP KLLIYAASSLQSGVPSRFSGSGSGTDFTLTISSLQPEDFATYYCQQ EYNTPPTFGGGTKVEIKRTVAAPSVFIFPPSDEQLKSGTASVVCL LNNFYPREAKVQWKVDNALQSGNSQESVTEQDSKDSTYSLSST LTLSKADYEKHKVYACEVTHQGLSSPVTKSFNRGEC |
| 33 | ABP98 | Full Light | DIQMTQSPSSLSASVGDRVTITCRASKSIDSYLNWYQQKPGKAP KLLIYAASSLQSGVPSRFSGSGSGTDFTLTISSLQPEDFATYYCQQ EYNTPPTFGGGTKVEIKRTVAAPSVFIFPPSDEQLKSGTASVVCL LNNFYPREAKVQWKVDNALQSGNSQESVTEQDSKDSTYSLSST LTLSKADYEKHKVYACEVTHQGLSSPVTKSFNRGEC |
| 39 | ABP99 | Full Light | DIQMTQSPSSLSASVGDRVTITCRASQSISSYLNWYQQKPGKAP KLLIYAADSLQSGVPSRFSGSGSGTDFTLTISSLQPEDFATYYCQ QEYNTPPTFGGGTKVEIKRTVAAPSVFIFPPSDEQLKSGTASVVC LLNNFYPREAKVQWKVDNALQSGNSQESVTEQDSKDSTYSLSS TLTLSKADYEKHKVYACEVTHQGLSSPVTKSFNRGEC |
| 43 | ABP100 | Full Light | DIQMTQSPSSLSASVGDRVTITCRASQSINSYLNWYQQKPGKAP KLLIYAASSLDSGVPSRFSGSGSGTDFTLTISSLQPEDFATYYCQQ EYNTPPTFGGGTKVEIKRTVAAPSVFIFPPSDEQLKSGTASVVCL LNNFYPREAKVQWKVDNALQSGNSQESVTEQDSKDSTYSLSST LTLSKADYEKHKVYACEVTHQGLSSPVTKSFNRGEC |
| 52 | ABP101 | Full Light | DIQMTQSPSSLSASVGDRVTITCGASQSISTYLNWYQQKPGKAP KLLIYSASSLESGVPSRFSGSGSGTDFTLTISSLQPEDFATYYCQQ EYNTPPSFGGGTKVEIKRTVAAPSVFIFPPSDEQLKSGTASVVCL LNNFYPREAKVQWKVDNALQSGNSQESVTEQDSKDSTYSLSST LTLSKADYEKHKVYACEVTHQGLSSPVTKSFNRGEC |
| 107 | ABP102 | Full Light | DIVMTQSPLSLPVTPGEPASISCRSSQSLLHSNGYNYLDWYLQKP GQSPQLLIYLGSNRASGVPDRFSGSGSGTDFTLKISRVEAEDVGV YYCMQKIGTPLTFGGGTKVEIKRTVAAPSVFIFPPSDEQLKSGTA SVVCLLNNFYPREAKVQWKVDNALQSGNSQESVTEQDSKDSTY SLSSTLTLSKADYEKHKVYACEVTHQGLSSPVTKSFNRGEC |
| 107 | ABP103 | Full Light | DIVMTQSPLSLPVTPGEPASISCRSSQSLLHSNGYNYLDWYLQKP GQSPQLLIYLGSNRASGVPDRFSGSGSGTDFTLKISRVEAEDVGV YYCMQKIGTPLTFGGGTKVEIKRTVAAPSVFIFPPSDEQLKSGTA SVVCLLNNFYPREAKVQWKVDNALQSGNSQESVTEQDSKDSTY SLSSTLTLSKADYEKHKVYACEVTHQGLSSPVTKSFNRGEC |
| 109 | ABP104 | Full Light | DIQLTQSPSSVSASVGDRVTITCRASQGISSWLAWYQQKPGKAP KLLIYGASSLQSGVPSRFSGSGSGTDFTLTISSLQPEDFATYYCQQ ASLFPPTFGGGTKVEIKRTVAAPSVFIFPPSDEQLKSGTASVVCLL NNFYPREAKVQWKVDNALQSGNSQESVTEQDSKDSTYSLSSTL TLSKADYEKHKVYACEVTHQGLSSPVTKSFNRGEC |

APPENDIX A-continued

SEQUENCES

| SEQ ID NO | Molecule | Description | SEQUENCE |
|---|---|---|---|
| 111 | ABP105 | Full Light | EIVLTQSPATLSLSPGERATLSCRASQSVSSYLAWYQQKPGQAP RLLIYDASNRATGIPARFSGSGSGTDFTLTISSLEPEDFAVYYCQQ RLVFPPTFGGGTKVEIKRTVAAPSVFIFPPSDEQLKSGTASVVCL LNNFYPREAKVQWKVDNALQSGNSQESVTEQDSKDSTYSLSST LTLSKADYEKHKVYACEVTHQGLSSPVTKSFNRGEC |
| 111 | ABP106 | Full Light | EIVLTQSPATLSLSPGERATLSCRASQSVSSYLAWYQQKPGQAP RLLIYDASNRATGIPARFSGSGSGTDFTLTISSLEPEDFAVYYCQQ RLVFPPTFGGGTKVEIKRTVAAPSVFIFPPSDEQLKSGTASVVCL LNNFYPREAKVQWKVDNALQSGNSQESVTEQDSKDSTYSLSST LTLSKADYEKHKVYACEVTHQGLSSPVTKSFNRGEC |
| 111 | ABP107 | Full Light | EIVLTQSPATLSLSPGERATLSCRASQSVSSYLAWYQQKPGQAP RLLIYDASNRATGIPARFSGSGSGTDFTLTISSLEPEDFAVYYCQQ RLVFPPTFGGGTKVEIKRTVAAPSVFIFPPSDEQLKSGTASVVCL LNNFYPREAKVQWKVDNALQSGNSQESVTEQDSKDSTYSLSST LTLSKADYEKHKVYACEVTHQGLSSPVTKSFNRGEC |
| 113 | ABP108 | Full Light | EIVLTQSPATLSLSPGERATLSCRASQSVSSYLAWYQQKPGQAP RLLIYDASNRATGIPARFSGSGSGTDFTLTISSLEPEDFAVYYCQQ HSVFPPTFGGGTKVEIKRTVAAPSVFIFPPSDEQLKSGTASVVCL LNNFYPREAKVQWKVDNALQSGNSQESVTEQDSKDSTYSLSST LTLSKADYEKHKVYACEVTHQGLSSPVTKSFNRGEC |
| 113 | ABP109 | Full Light | EIVLTQSPATLSLSPGERATLSCRASQSVSSYLAWYQQKPGQAP RLLIYDASNRATGIPARFSGSGSGTDFTLTISSLEPEDFAVYYCQQ HSVFPPTFGGGTKVEIKRTVAAPSVFIFPPSDEQLKSGTASVVCL LNNFYPREAKVQWKVDNALQSGNSQESVTEQDSKDSTYSLSST LTLSKADYEKHKVYACEVTHQGLSSPVTKSFNRGEC |

SEQUENCE LISTING (233 sequences)

SEQ ID NO: 1 - protein, 241 aa, Homo sapiens
MAQHGAMGAFRALCGLALLCALSLGQRPTGGPGCGPGRLLLGTGTDARCCRVHTTRCCRDYPGEECCSEWDCMCVQPEFHCGDPCCTTCRHHPCPPGQGVQSQGKFSFGFQCIDCASGTFSGGHEGHCKPWTDCTQFGFLTVFPGNKTHNAVCVPGSPPAEPLGWLTVVLLAVAACVLLLTSAQLGLHIWQLRSQCMWPRETQLLLEVPPSTEDARSCQFPEEERGERSAEEKGRLGDLWV

SEQ ID NO: 2 - protein, 241 aa, Artificial Sequence
  source: /note="Description of Artificial Sequence: Synthetic polypeptide"
MAQHGAMGAFRALCGLALLCALSLGQRPTGGPGCGPGRLLLGRGTDARCCRVHTTRCCRDYPGEECCSEWDCMCVQPEFHCGDPCCTTCRHHPCPPGQGVQSQGKFSFGFQCIDCASGTFSGGHEGHCKPWTDCTQFGFLTVFPGNKTHNAVCVPGSPPAEPLGWLTVVLLAVAACVLLLTSAQLGLHIWQLRSQCMWPRETQLLLEVPPSTEDARSCQFPEEERGERSAEEKGRLGDLWV

SEQ ID NO: 3 - protein, 235 aa, Macaca fascicularis
MCACGTLCCLALLCAASLGQRPTGGPGCGPGRLLLGTGKDARCCRVHPTRCCRDYQSEECCSEWDCVCVQPEFHCGNPCCTTCQHHPCPSGQGVQPQGKFSFGFRCVDCALGTFSRGHDGHCKPWTDCTQFGFLTVFPGNKTHNAVCVPGSPPAEPPGWLTIVLLAVAACVLLLTSAQLGLHIWQLGSQPTGPRETQLLLEVPPSTEDASSCQFPEEERGERLAEEKGRLGDLWV

SEQ ID NO: 4 - protein, 228 aa, Mus musculus
MGAWAMLYGVSMLCVLDLGQPSVVEEPGCGPGKVQNGSGNNTRCCSLYAPGKEDCPKERCICVTPEYHCGDPQCKICKHYPCQPGQRVESQGDIVFGFRCVACAMGTFSAGRDGHCRLWTNCSQFGFLTMFPGNKTHNAVCIPEPLPTEQYGHLTVIFLVMAACIFFLTTVQLGLHIWQLRRQHMCPRETQPFAEVQLSAEDACSFQFPEEERGEQTEEKCHLGGRWP

SEQ ID NO: 5 - protein, 5 aa, Artificial Sequence
  source: /note="Description of Artificial Sequence: Synthetic peptide"
GGGGS

SEQ ID NO: 6 - protein, 15 aa, Artificial Sequence
  source: /note="Description of Artificial Sequence: Synthetic peptide"
GGGGSGGGGSGGGGS

SEQ ID NO: 7 - protein, 687 aa, Artificial Sequence
  source: /note="Description of Artificial Sequence: Synthetic polypeptide"
QVQLQESGPGLVKPSETLSLTCAVSGYSISSGLGWGWIRQPPGKGLEWIGGIYESGSTYYNPSLKSRVTISVDTSKNQFSLKLSSVTAADTAVYYCAHERVRGYGDYGGHHAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCGGGGSQVQLQESGPGLVKPSETLSLTCAVSGYSISSGLGWGWIRQPPGKGLEWIGGIYESGSTYYNPSLKSRVTISVDTSKNQFSLKLSSVTAADTAVYYCAHERVRGYGDYGGHHAFDIWGQGTMVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 8 - protein, 214 aa, Artificial Sequence
  source: /note="Description of Artificial Sequence: Synthetic polypeptide"
DIQMTQSPSSLSASVGDRVTITCRASQSISSYLNWYQQKPGKAPKLLIYAASSLQSGVPSRFSGSGSGTDFTLTISSLQPEDFATYYCQQEYATPPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9 - protein, 126 aa, Artificial Sequence
  source: /note="Description of Artificial Sequence: Synthetic polypeptide"
QVQLQESGPGLVKPSETLSLTCAVSGYSISSGLGWGWIRQPPGKGLEWIGGIYESGSTYYNPSLKSRVTISVDTSKNQFSLKLSSVTAADTAVYYCAHERVRGYGDYGGHHAFDIWGQGTMVTVSS

SEQ ID NO: 10 - protein, 107 aa, Artificial Sequence
  source: /note="Description of Artificial Sequence: Synthetic polypeptide"
DIQMTQSPSSLSASVGDRVTITCRASQSISSYLNWYQQKPGKAPKLLIYAASSLQSGVPSRFSGSGSGTDFTLTISSLQPEDFATYYCQQEYATPPTFGGGTKVEIK

SEQ ID NO: 11 - protein, 10 aa, Artificial Sequence
  source: /note="Description of Artificial Sequence: Synthetic peptide"
YSISSGLGWG

SEQ ID NO: 12 - protein, 16 aa, Artificial Sequence
  source: /note="Description of Artificial Sequence: Synthetic peptide"
GIYESGSTYYNPSLKS

SEQ ID NO: 13 - protein, 19 aa, Artificial Sequence
  source: /note="Description of Artificial Sequence: Synthetic peptide"
AHERVRGYGDYGGHHAFDI

SEQ ID NO: 14 - protein, 11 aa, Artificial Sequence
  source: /note="Description of Artificial Sequence: Synthetic peptide"
RASQSISSYLN

SEQ ID NO: 15 - protein, 7 aa, Artificial Sequence
  source: /note="Description of Artificial Sequence: Synthetic peptide"
AASSLQS

SEQ ID NO: 16 - protein, 9 aa, Artificial Sequence
  source: /note="Description of Artificial Sequence: Synthetic peptide"
QQEYATPPT

SEQ ID NO: 17 - protein, 9 aa, Artificial Sequence
  source: /note="Description of Artificial Sequence: Synthetic peptide"
QQEYNTPPT

SEQ ID NO: 18 - protein, 214 aa, Artificial Sequence
  source: /note="Description of Artificial Sequence: Synthetic polypeptide"
DIQMTQSPSSLSASVGDRVTITCRASQSISSYLNWYQQKPGKAPKLLIYAASSLQSGVPSRFSGSGSGTDFTLTISSLQPEDFATYYCQQEYNTPPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19 - protein, 127 aa, Artificial Sequence
  source: /note="Description of Artificial Sequence: Synthetic polypeptide"
QVQLQESGPGLVKPSQTLSLTCTVSGGSISSGGAVWSWIRQHPGKGLEWIGGIAYSGSTYYNPSLKSRVTISVDTSKNQFSLKLSSVTAADTAVYYCADENVRGYGDYGGHHAFDIWGQGTMVTVSS

SEQ ID NO: 20 - protein, 107 aa, Artificial Sequence
  source: /note="Description of Artificial Sequence: Synthetic polypeptide"
DIQMTQSPSSLSASVGDRVTITCRASQSISSYLNWYQQKPGKAPKLLIYAASSLQSGVPSRFSGSGSGTDFTLTISSLQPEDFATYYCQQEYNTPPTFGGGTKVEIK

SEQ ID NO: 21 - protein, 11 aa, Artificial Sequence
  source: /note="Description of Artificial Sequence: Synthetic peptide"
GSISSGGAVWS

SEQ ID NO: 22 - protein, 16 aa, Artificial Sequence
  source: /note="Description of Artificial Sequence: Synthetic peptide"
GIAYSGSTYYNPSLKS

SEQ ID NO: 23 - protein, 19 aa, Artificial Sequence
  source: /note="Description of Artificial Sequence: Synthetic peptide"
ADENVRGYGDYGGHHAFDI

SEQ ID NO: 24 - protein, 687 aa, Artificial Sequence
  source: /note="Description of Artificial Sequence: Synthetic polypeptide"
QVQLQESGPGLVKPSETLSLTCAVSGYSISSGAGWGWIRQPPGKGLEWIGLIVHSGSTYYNPSLKSRVTISVDTSKNQFSLKLSSVTAADTAVYYCVLESVRGYGDYGGHHAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCGGGGSQVQLQESGPGLVKPSETLSLTCAVSGYSISSGAGWGWIRQPPGKGLEWIGLIVHSGSTYYNPSLKSRVTISVDTSKNQFSLKLSSVTAADTAVYYCVLESVRGYGDYGGHHAFDIWGQGTMVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 25 - protein, 214 aa, Artificial Sequence
  source: /note="Description of Artificial Sequence: Synthetic polypeptide"
DIQMTQSPSSLSASVGDRVTITCRASQSISSYLNWYQQKPGKAPKLLIYAASSLKYGVPSRFSGSGSGTDFTLTISSLQPEDFATYYCQQEYNTPPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26 - protein, 126 aa, Artificial Sequence
  source: /note="Description of Artificial Sequence: Synthetic polypeptide"
QVQLQESGPGLVKPSETLSLTCAVSGYSISSGAGWGWIRQPPGKGLEWIGLIVHSGSTYYNPSLKSRVTISVDTSKNQFSLKLSSVTAADTAVYYCVLESVRGYGDYGGHHAFDIWGQGTMVTVSS

SEQ ID NO: 27 - protein, 107 aa, Artificial Sequence
  source: /note="Description of Artificial Sequence: Synthetic polypeptide"
DIQMTQSPSSLSASVGDRVTITCRASQSISSYLNWYQQKPGKAPKLLIYAASSLKYGVPSRFSGSGSGTDFTLTISSLQPEDFATYYCQQEYNTPPTFGGGTKVEIK

SEQ ID NO: 28 - protein, 10 aa, Artificial Sequence
  source: /note="Description of Artificial Sequence: Synthetic peptide"
YSISSGAGWG

SEQ ID NO: 29 - protein, 16 aa, Artificial Sequence
  source: /note="Description of Artificial Sequence: Synthetic peptide"
LIVHSGSTYYNPSLKS

SEQ ID NO: 30 - protein, 19 aa, Artificial Sequence
  source: /note="Description of Artificial Sequence: Synthetic peptide"
VLESVRGYGDYGGHHAFDI

SEQ ID NO: 31 - protein, 7 aa, Artificial Sequence
  source: /note="Description of Artificial Sequence: Synthetic peptide"
AASSLKY

SEQ ID NO: 32 - protein, 687 aa, Artificial Sequence
  source: /note="Description of Artificial Sequence: Synthetic polypeptide"
QVQLQESGPGLVKPSETLSLTCAVSGYSISSGAGWGWIRQPPGKGPEWIGLIVHSGSTYYNPSLKSRVTISVDTSKNQFSLKLSSVTAADTAVYYCVLESVRGYGDYGGHHAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCGGGGSQVQLQESGPGLVKPSETLSLTCAVSGYSISSGAGWGWIRQPPGKGPEWIGLIVHSGSTYYNPSLKSRVTISVDTSKNQFSLKLSSVTAADTAVYYCVLESVRGYGDYGGHHAFDIWGQGTMVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 33 - protein, 214 aa, Artificial Sequence
  source: /note="Description of Artificial Sequence: Synthetic polypeptide"
DIQMTQSPSSLSASVGDRVTITCRASKSIDSYLNWYQQKPGKAPKLLIYAASSLQSGVPSRFSGSGSGTDFTLTISSLQPEDFATYYCQQEYNTPPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 34 - protein, 126 aa, Artificial Sequence
  source: /note="Description of Artificial Sequence: Synthetic polypeptide"
QVQLQESGPGLVKPSETLSLTCAVSGYSISSGAGWGWIRQPPGKGPEWIGLIVHSGSTYYNPSLKSRVTISVDTSKNQFSLKLSSVTAADTAVYYCVLESVRGYGDYGGHHAFDIWGQGTMVTVSS

SEQ ID NO: 35 - protein, 107 aa, Artificial Sequence
  source: /note="Description of Artificial Sequence: Synthetic polypeptide"
DIQMTQSPSSLSASVGDRVTITCRASKSIDSYLNWYQQKPGKAPKLLIYAASSLQSGVPSRFSGSGSGTDFTLTISSLQPEDFATYYCQQEYNTPPTFGGGTKVEIK

SEQ ID NO: 36 - protein, 11 aa, Artificial Sequence
  source: /note="Description of Artificial Sequence: Synthetic peptide"
RASKSIDSYLN

SEQ ID NO: 37 - protein, 687 aa, Artificial Sequence; identical to SEQ ID NO: 24
  source: /note="Description of Artificial Sequence: Synthetic polypeptide"

SEQ ID NO: 38 - protein, 687 aa, Artificial Sequence; identical to SEQ ID NO: 24
  source: /note="Description of Artificial Sequence: Synthetic polypeptide"

SEQ ID NO: 39 - protein, 214 aa, Artificial Sequence
  source: /note="Description of Artificial Sequence: Synthetic polypeptide"
DIQMTQSPSSLSASVGDRVTITCRASQSISSYLNWYQQKPGKAPKLLIYAADSLQSGVPSRFSGSGSGTDFTLTISSLQPEDFATYYCQQEYNTPPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 40 - protein, 107 aa, Artificial Sequence
  source: /note="Description of Artificial Sequence: Synthetic polypeptide"
DIQMTQSPSSLSASVGDRVTITCRASQSISSYLNWYQQKPGKAPKLLIYAADSLQSGVPSRFSGSGSGTDFTLTISSLQPEDFATYYCQQEYNTPPTFGGGTKVEIK

SEQ ID NO: 41 - protein, 7 aa, Artificial Sequence
  source: /note="Description of Artificial Sequence: Synthetic peptide"
AADSLQS

SEQ ID NO: 42 - protein, 687 aa, Artificial Sequence
  source: /note="Description of Artificial Sequence: Synthetic polypeptide"
QVQLQESGPGLVKPSETLSLTCAVSGYSISSEYMWGWIRQPPGKGLEWIGLIYHSGKTYYNPSLKSRVTISVDTSKNQFSLKLSSVTAADTAVYYCAREADRGYGDYGGHHAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCGGGGSQVQLQESGPGLVKPSETLSLTCAVSGYSISSEYMWGWIRQPPGKGLEWIGLIYHSGKTYYNPSLKSRVTISVDTSKNQFSLKLSSVTAADTAVYYCAREADRGYGDYGGHHAFDIWGQGTMVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 43 - protein, 214 aa, Artificial Sequence
  source: /note="Description of Artificial Sequence: Synthetic polypeptide"
DIQMTQSPSSLSASVGDRVTITCRASQSINSYLNWYQQKPGKAPKLLIYAASSLDSGVPSRFSGSGSGTDFTLTISSLQPEDFATYYCQQEYNTPPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 44 - protein, 126 aa, Artificial Sequence
  source: /note="Description of Artificial Sequence: Synthetic polypeptide"
QVQLQESGPGLVKPSETLSLTCAVSGYSISSEYMWGWIRQPPGKGLEWIGLIYHSGKTYYNPSLKSRVTISVDTSKNQFSLKLSSVTAADTAVYYCAREADRGYGDYGGHHAFDIWGQGTMVTVSS

SEQ ID NO: 45 - protein, 107 aa, Artificial Sequence
  source: /note="Description of Artificial Sequence: Synthetic polypeptide"
DIQMTQSPSSLSASVGDRVTITCRASQSINSYLNWYQQKPGKAPKLLIYAASSLDSGVPSRFSGSGSGTDFTLTISSLQPEDFATYYCQQEYNTPPTFGGGTKVEIK

SEQ ID NO: 46 - protein, 10 aa, Artificial Sequence
  source: /note="Description of Artificial Sequence: Synthetic peptide"
YSISSEYMWG

SEQ ID NO: 47 - protein, 16 aa, Artificial Sequence
  source: /note="Description of Artificial Sequence: Synthetic peptide"
LIYHSGKTYYNPSLKS

SEQ ID NO: 48 - protein, 19 aa, Artificial Sequence
  source: /note="Description of Artificial Sequence: Synthetic peptide"
AREADRGYGDYGGHHAFDI

SEQ ID NO: 49 - protein, 11 aa, Artificial Sequence
  source: /note="Description of Artificial Sequence: Synthetic peptide"
RASQSINSYLN

SEQ ID NO: 50 - protein, 7 aa, Artificial Sequence
  source: /note="Description of Artificial Sequence: Synthetic peptide"
AASSLDS

SEQ ID NO: 51 - protein, 687 aa, Artificial Sequence; identical to SEQ ID NO: 42
  source: /note="Description of Artificial Sequence: Synthetic polypeptide"

SEQ ID NO: 52 - protein, 214 aa, Artificial Sequence
  source: /note="Description of Artificial Sequence: Synthetic polypeptide"
DIQMTQSPSSLSASVGDRVTITCGASQSISTYLNWYQQKPGKAPKLLIYSASSLESGVPSRFSGSGSGTDFTLTISSLQPEDFATYYCQQEYNTPPSFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 53 - protein, 107 aa, Artificial Sequence
  source: /note="Description of Artificial Sequence: Synthetic polypeptide"
DIQMTQSPSSLSASVGDRVTITCGASQSISTYLNWYQQKPGKAPKLLIYSASSLESGVPSRFSGSGSGTDFTLTISSLQPEDFATYYCQQEYNTPPSFGGGTKVEIK

SEQ ID NO: 54 - protein, 11 aa, Artificial Sequence
  source: /note="Description of Artificial Sequence: Synthetic peptide"
GASQSISTYLN

SEQ ID NO: 55 - protein, 7 aa, Artificial Sequence
  source: /note="Description of Artificial Sequence: Synthetic peptide"
SASSLES

SEQ ID NO: 56 - protein, 9 aa, Artificial Sequence
  source: /note="Description of Artificial Sequence: Synthetic peptide"
QQEYNTPPS

SEQ ID NO: 57 - protein, 689 aa, Artificial Sequence
  source: /note="Description of Artificial Sequence: Synthetic polypeptide"
QLQLQESGPGLVKPSETLSLTCTVSGGSISSSSYAWGWIRQPPGKGLEWIGSIYYSGSTYYNPSLKSRVTISVDTSKNQFSLKLSSVTAADTAVYYCARDSGRGYGDYGGHHAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCGGGGSQLQLQESGPGLVKPSETLSLTCTVSGGSISSSSYAWGWIRQPPGKGLEWIGSIYYSGSTYYNPSLKSRVTISVDTSKNQFSLKLSSVTAADTAVYYCARDSGRGYGDYGGHHAFDIWGQGTMVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 58 - protein, 127 aa, Artificial Sequence
  source: /note="Description of Artificial Sequence: Synthetic polypeptide"
QLQLQESGPGLVKPSETLSLTCTVSGGSISSSSYAWGWIRQPPGKGLEWIGSIYYSGSTYYNPSLKSRVTISVDTSKNQFSLKLSSVTAADTAVYYCARDSGRGYGDYGGHHAFDIWGQGTMVTVSS

SEQ ID NO: 59 - protein, 11 aa, Artificial Sequence
  source: /note="Description of Artificial Sequence: Synthetic peptide"
GSISSSSYAWG

SEQ ID NO: 60 - protein, 16 aa, Artificial Sequence
  source: /note="Description of Artificial Sequence: Synthetic peptide"
SIYYSGSTYYNPSLKS

SEQ ID NO: 61 - protein, 19 aa, Artificial Sequence
  source: /note="Description of Artificial Sequence: Synthetic peptide"
ARDSGRGYGDYGGHHAFDI

SEQ ID NO: 62 - protein, 125 aa, Artificial Sequence
  source: /note="Description of Artificial Sequence: Synthetic polypeptide"
QVQLVQSGAEVKRPGSSVKVSCKASGGTFSSYYISWVRQVPGQGLEWMGGIIPVPGTANYAQKFQGRVTITADESTSTAYMELSSLRSEDTAVYYCARAGGGYARGDHYYGMDVWGQGTTVTVSS

SEQ ID NO: 63 - protein, 112 aa, Artificial Sequence
  source: /note="Description of Artificial Sequence: Synthetic polypeptide"
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQKIGTPLTFGGGTKVEIK

SEQ ID NO: 64 - protein, 9 aa, Artificial Sequence
  source: /note="Description of Artificial Sequence: Synthetic peptide"
GTFSSYYIS

SEQ ID NO: 65 - protein, 17 aa, Artificial Sequence
  source: /note="Description of Artificial Sequence: Synthetic peptide"
GIIPVPGTANYAQKFQG

SEQ ID NO: 66 - protein, 18 aa, Artificial Sequence
  source: /note="Description of Artificial Sequence: Synthetic peptide"
ARAGGGYARGDHYYGMDV

SEQ ID NO: 67 - protein, 16 aa, Artificial Sequence
  source: /note="Description of Artificial Sequence: Synthetic peptide"
RSSQSLLHSNGYNYLD

SEQ ID NO: 68 - protein, 7 aa, Artificial Sequence
  source: /note="Description of Artificial Sequence: Synthetic peptide"
LGSNRAS

SEQ ID NO: 69 - protein, 9 aa, Artificial Sequence
  source: /note="Description of Artificial Sequence: Synthetic peptide"
MQKIGTPLT

SEQ ID NO: 70 - protein, 125 aa, Artificial Sequence
  source: /note="Description of Artificial Sequence: Synthetic polypeptide"
QVQLVQSGAEVKKPGSSVKVSCKASGGTFSSYYISWVRQAPGQRLEWMGGIIPVPGTANYAQKFQGRVTITADESTSTAYMELSSLRSEDTAVYYCARAGGGYARGDHYYGMDVWGQGTTVTVSS

SEQ ID NO: 71 - protein, 121 aa, Artificial Sequence
  source: /note="Description of Artificial Sequence: Synthetic polypeptide"
QVQLVQSGAEVKKPGSSVKVSCKASGGTFSRGAISWVRQAPGQGLEWMGGIIPIEGTAYYAQKFQGRVTITADESTGTAYMELSSLRSEDTAVYYCARQSDYGLPRGMDVWGQGTTVTVSS

SEQ ID NO: 72 - protein, 107 aa, Artificial Sequence
  source: /note="Description of Artificial Sequence: Synthetic polypeptide"
DIQLTQSPSSVSASVGDRVTITCRASQGISSWLAWYQQKPGKAPKLLIYGASSLQSGVPSRFSGSGSGTDFTLTISSLQPEDFATYYCQQASLFPPTFGGGTKVEIK

SEQ ID NO: 73 - protein, 9 aa, Artificial Sequence
  source: /note="Description of Artificial Sequence: Synthetic peptide"
GTFSRGAIS

SEQ ID NO: 74 - protein, 17 aa, Artificial Sequence
  source: /note="Description of Artificial Sequence: Synthetic peptide"
GIIPIEGTAYYAQKFQG

SEQ ID NO: 75 - protein, 14 aa, Artificial Sequence
  source: /note="Description of Artificial Sequence: Synthetic peptide"
ARQSDYGLPRGMDV

SEQ ID NO: 76 - protein, 11 aa, Artificial Sequence
  source: /note="Description of Artificial Sequence: Synthetic peptide"
RASQGISSWLA

SEQ ID NO: 77 - protein, 7 aa, Artificial Sequence
  source: /note="Description of Artificial Sequence: Synthetic peptide"
GASSLQS

SEQ ID NO: 78 - protein, 9 aa, Artificial Sequence
  source: /note="Description of Artificial Sequence: Synthetic peptide"
QQASLFPPT

SEQ ID NO: 79 - protein, 120 aa, Artificial Sequence
  source: /note="Description of Artificial Sequence: Synthetic polypeptide"
QVQLVQSGAEVKKPGSSVKVSCKASGGTFSSYAISWVRQAPGQGLEWMGGIIPISGFTNYAQKFQGRVTITADESTSTAYMELSSLRSEDTAVYYCAREGGHYYSGWPYWGQGTLVTVSS

SEQ ID NO: 80 - protein, 107 aa, Artificial Sequence
  source: /note="Description of Artificial Sequence: Synthetic polypeptide"
EIVLTQSPATLSLSPGERATLSCRASQSVSSYLAWYQQKPGQAPRLLIYDASNRATGIPARFSGSGSGTDFTLTISSLEPEDFAVYYCQQRLVFPPTFGGGTKVEIK

SEQ ID NO: 81 - protein, 9 aa, Artificial Sequence
  source: /note="Description of Artificial Sequence: Synthetic peptide"
GTFSSYAIS

SEQ ID NO: 82 - protein, 17 aa, Artificial Sequence
  source: /note="Description of Artificial Sequence: Synthetic peptide"
GIIPISGFTNYAQKFQG

SEQ ID NO: 83 - protein, 13 aa, Artificial Sequence
  source: /note="Description of Artificial Sequence: Synthetic peptide"
AREGGHYYSGWPY

SEQ ID NO: 84 - protein, 11 aa, Artificial Sequence
  source: /note="Description of Artificial Sequence: Synthetic peptide"
RASQSVSSYLA

SEQ ID NO: 85 - protein, 7 aa, Artificial Sequence
  source: /note="Description of Artificial Sequence: Synthetic peptide"
DASNRAT

SEQ ID NO: 86 - protein, 9 aa, Artificial Sequence
  source: /note="Description of Artificial Sequence: Synthetic peptide"
QQRLVFPPT

SEQ ID NO: 87 - protein, 120 aa, Artificial Sequence
  source: /note="Description of Artificial Sequence: Synthetic polypeptide"
QVQLVQSGAEVKKPGSSVKVSCKASGGTFSSYAISWVRQAPGQRLEWMGGIIPISGFTNYAQKFQGRVTITADESTSTAYMELSSLRSEDTAVYYCAREGGHYYSGWPYWGQGTLVTVSS

SEQ ID NO: 88 - protein, 120 aa, Artificial Sequence
  source: /note="Description of Artificial Sequence: Synthetic polypeptide"
QVQLVQSGAEVKKPGSSVKVSCKASGGTFSSYAISWVRQAPGQGLEWMGGIIPISGFTNYAQKFQGKVTITADESTSTAYMELSSLRSEDTAVYYCAREGGHYYSGWPYWGQGTLVTVSS

SEQ ID NO: 89 - protein, 119 aa, Artificial Sequence
  source: /note="Description of Artificial Sequence: Synthetic polypeptide"
QVQLVQSGAEVKKPGSSVKVSCKASGGTFVRYAISWVRQAPGQGLEWMGGIIPIFGEAQYAQRFQGRVTITADESTSTAYMELSSLRSEDTAVYYCAREGYYYGALPYWGQGTLVTVSS

SEQ ID NO: 90 - protein, 107 aa, Artificial Sequence
  source: /note="Description of Artificial Sequence: Synthetic polypeptide"
EIVLTQSPATLSLSPGERATLSCRASQSVSSYLAWYQQKPGQAPRLLIYDASNRATGIPARFSGSGSGTDFTLTISSLEPEDFAVYYCQQHSVFPPTFGGGTKVEIK

SEQ ID NO: 91 - protein, 9 aa, Artificial Sequence
  source: /note="Description of Artificial Sequence: Synthetic peptide"
GTFVRYAIS

SEQ ID NO: 92 - protein, 17 aa, Artificial Sequence
  source: /note="Description of Artificial Sequence: Synthetic peptide"
GIIPIFGEAQYAQRFQG

SEQ ID NO: 93 - protein, 12 aa, Artificial Sequence
  source: /note="Description of Artificial Sequence: Synthetic peptide"
AREGYYYGALPY

SEQ ID NO: 94 - protein, 9 aa, Artificial Sequence
  source: /note="Description of Artificial Sequence: Synthetic peptide"
QQHSVFPPT

SEQ ID NO: 95 - protein, 119 aa, Artificial Sequence
  source: /note="Description of Artificial Sequence: Synthetic polypeptide"
QVQLVQSGAEVKKPGSSVKVSCKASGGTFVRYAISWVRQAPGQGLEWMGGIIPIFGEAQYAQKFRGRATITADESTSTAYMELSSLRSEDTAVYYCAREGYYYGALPYWGQGTLVTVSS

SEQ ID NO: 96 - protein, 17 aa, Artificial Sequence
  source: /note="Description of Artificial Sequence: Synthetic peptide"
GIIPIFGEAQYAQKFRG

SEQ ID NO: 97 - protein, 125 aa, Artificial Sequence
  source: /note="Description of Artificial Sequence: Synthetic polypeptide"
QVQLVQSGAEVKKPGSSVKVSCKASGGTFSSYYISWVRQAPGQGLEWMGGIIPVPGTANYAQKFQGRVTITADESTSTAYMELSSLRSEDTAVYYCARAGGGYARGDHYYGMDVWGQGTTVTVSS

SEQ ID NO: 98 - protein, 121 aa, Artificial Sequence
  source: /note="Description of Artificial Sequence: Synthetic polypeptide"
QVQLVQSGAEVKKPGSSVKVSCKASGGTFSRGAISWVRQAPGQGLEWMGGIIPIEGTAYYAQKFQGRVTITADESTSTAYMELSSLRSEDTAVYYCARQSDYGLPRGMDVWGQGTTVTVSS

SEQ ID NO: 99 - protein, 120 aa, Artificial Sequence
  source: /note="Description of Artificial Sequence: Synthetic polypeptide"
QVQLVQSGAEVKKPGSSVKVSCKASGGTFSSYAISWVRQAPGQGLEWMGGIIPISGFANYAQKFQGRVTITADESTSTAYMELSSLRSEDTAVYYCAREGGHYYSGWPYWGQGTLVTVSS

SEQ ID NO: 100 - protein, 17 aa, Artificial Sequence
  source: /note="Description of Artificial Sequence: Synthetic peptide"
GIIPISGFANYAQKFQG

SEQ ID NO: 101 - protein, 119 aa, Artificial Sequence
  source: /note="Description of Artificial Sequence: Synthetic polypeptide"
QVQLVQSGAEVKKPGSSVKVSCKASGGTFVRYAISWVRQAPGQGLEWMGGIIPIFGEAQYAQKFQGRVTITADESTSTAYMELSSLRSEDTAVYYCAREGYYYGALPYWGQGTLVTVSS

SEQ ID NO: 102 - protein, 17 aa, Artificial Sequence
  source: /note="Description of Artificial Sequence: Synthetic peptide"
GIIPIFGEAQYAQKFQG

SEQ ID NO: 103 - protein, 19 aa, Artificial Sequence
  source: /note="Description of Artificial Sequence: Synthetic peptide"
ARDSVRGYGDYGGHHAFDI

SEQ ID NO: 104 - protein, 126 aa, Artificial Sequence
  source: /note="Description of Artificial Sequence: Synthetic polypeptide"
QVQLQESGPGLVKPSETLSLTCAVSGYSISSEYMWGWIRQPPGKGLEWIGLIYHSGKTYYNPSLKSRVTISVDTSKNQFSLKLSSVTAADTAVYYCARDSGRGYGDYGGHHAFDIWGQGTMVTVSS

SEQ ID NO: 105 - protein, 127 aa, Artificial Sequence
  source: /note="Description of Artificial Sequence: Synthetic polypeptide"
QVQLQESGPGLVKPSQTLSLTCTVSGGSISSGGAVWSWIRQHPGKGLEWIGGIAYSGSTYYNPSLKSRVTISVDTSKNQFSLKLSSVTAADTAVYYCARDSVRGYGDYGGHHAFDIWGQGTMVTVSS

SEQ ID NO: 106 - protein, 684 aa, Artificial Sequence
  source: /note="Description of Artificial Sequence: Synthetic polypeptide"
QVQLVQSGAEVKKPGSSVKVSCKASGGTFSSYYISWVRQAPGQGLEWMGGIIPVPGTANYAQKFQGRVTITADESTSTAYMELSSLRSEDTAVYYCARAGGGYARGDHYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCGGGGSQVQLVQSGAEVKKPGSSVKVSCKASGGTFSSYYISWVRQAPGQGLEWMGGIIPVPGTANYAQKFQGRVTITADESTSTAYMELSSLRSEDTAVYYCARAGGGYARGDHYYGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 107 - protein, 219 aa, Artificial Sequence
  source: /note="Description of Artificial Sequence: Synthetic polypeptide"
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQKIGTPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 108 - protein, 676 aa, Artificial Sequence
  source: /note="Description of Artificial Sequence: Synthetic polypeptide"
QVQLVQSGAEVKKPGSSVKVSCKASGGTFSRGAISWVRQAPGQGLEWMGGIIPIEGTAYYAQKFQGRVTITADESTSTAYMELSSLRSEDTAVYYCARQSDYGLPRGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCGGGGSQVQLVQSGAEVKKPGSSVKVSCKASGGTFSRGAISWVRQAPGQGLEWMGGIIPIEGTAYYAQKFQGRVTITADESTSTAYMELSSLRSEDTAVYYCARQSDYGLPRGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 109 - protein, 214 aa, Artificial Sequence
  source: /note="Description of Artificial Sequence: Synthetic polypeptide"
DIQLTQSPSSVSASVGDRVTITCRASQGISSWLAWYQQKPGKAPKLLIYGASSLQSGVPSRFSGSGSGTDFTLTISSLQPEDFATYYCQQASLFPPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 110 - protein, 674 aa, Artificial Sequence
  source: /note="Description of Artificial Sequence: Synthetic polypeptide"
QVQLVQSGAEVKKPGSSVKVSCKASGGTFSSYAISWVRQAPGQGLEWMGGIIPISGFANYAQKFQGRVTITADESTSTAYMELSSLRSEDTAVYYCAREGGHYYSGWPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCGGGGSQVQLVQSGAEVKKPGSSVKVSCKASGGTFSSYAISWVRQAPGQGLEWMGGIIPISGFANYAQKFQGRVTITADESTSTAYMELSSLRSEDTAVYYCAREGGHYYSGWPYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 111 - protein, 214 aa, Artificial Sequence
  source: /note="Description of Artificial Sequence: Synthetic polypeptide"
EIVLTQSPATLSLSPGERATLSCRASQSVSSYLAWYQQKPGQAPRLLIYDASNRATGIPARFSGSGSGTDFTLTISSLEPEDFAVYYCQQRLVFPPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 112 - protein, 672 aa, Artificial Sequence
  source: /note="Description of Artificial Sequence: Synthetic polypeptide"
QVQLVQSGAEVKKPGSSVKVSCKASGGTFVRYAISWVRQAPGQGLEWMGGIIPIFGEAQYAQKFQGRVTITADESTSTAYMELSSLRSEDTAVYYCAREGYYYGALPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCGGGGSQVQLVQSGAEVKKPGSSVKVSCKASGGTFVRYAISWVRQAPGQGLEWMGGIIPIFGEAQYAQKFQGRVTITADESTSTAYMELSSLRSEDTAVYYCAREGYYYGALPYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 113 - protein, 214 aa, Artificial Sequence
  source: /note="Description of Artificial Sequence: Synthetic polypeptide"
EIVLTQSPATLSLSPGERATLSCRASQSVSSYLAWYQQKPGQAPRLLIYDASNRATGIPARFSGSGSGTDFTLTISSLEPEDFAVYYCQQHSVFPPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 114 - protein, 686 aa, Artificial Sequence
  source: /note="Description of Artificial Sequence: Synthetic polypeptide"
QVQLQESGPGLVKPSETLSLTCAVSGYSISSEYMWGWIRQPPGKGLEWIGLIYHSGKTYYNPSLKSRVTISVDTSKNQFSLKLSSVTAADTAVYYCARDSGRGYGDYGGHHAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCGGGGSQVQLQESGPGLVKPSETLSLTCAVSGYSISSEYMWGWIRQPPGKGLEWIGLIYHSGKTYYNPSLKSRVTISVDTSKNQFSLKLSSVTAADTAVYYCARDSGRGYGDYGGHHAFDIWGQGTMVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 115 - protein, 688 aa, Artificial Sequence
  source: /note="Description of Artificial Sequence: Synthetic polypeptide"
QVQLQESGPGLVKPSQTLSLTCTVSGGSISSGGAVWSWIRQHPGKGLEWIGGIAYSGSTYYNPSLKSRVTISVDTSKNQFSLKLSSVTAADTAVYYCARDSVRGYGDYGGHHAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCGGGGSQVQLQESGPGLVKPSQTLSLTCTVSGGSISSGGAVWSWIRQHPGKGLEWIGGIAYSGSTYYNPSLKSRVTISVDTSKNQFSLKLSSVTAADTAVYYCARDSVRGYGDYGGHHAFDIWGQGTMVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 116 - protein, 694 aa, Artificial Sequence
  source: /note="Description of Artificial Sequence: Synthetic polypeptide"
QVQLVQSGAEVKKPGSSVKVSCKASGGTFSSYYISWVRQAPGQGLEWMGGIIPVPGTANYAQKFQGRVTITADESTSTAYMELSSLRSEDTAVYYCARAGGGYARGDHYYGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGGGGGSGGGGSGGGGSQVQLVQSGAEVKKPGSSVKVSCKASGGTFSSYYISWVRQAPGQGLEWMGGIIPVPGTANYAQKFQGRVTITADESTSTAYMELSSLRSEDTAVYYCARAGGGYARGDHYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSC

SEQ ID NO: 117 - protein, 686 aa, Artificial Sequence
  source: /note="Description of Artificial Sequence: Synthetic polypeptide"
QVQLVQSGAEVKKPGSSVKVSCKASGGTFSRGAISWVRQAPGQGLEWMGGIIPIEGTAYYAQKFQGRVTITADESTSTAYMELSSLRSEDTAVYYCARQSDYGLPRGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGGGGGSGGGGSGGGGSQVQLVQSGAEVKKPGSSVKVSCKASGGTFSRGAISWVRQAPGQGLEWMGGIIPIEGTAYYAQKFQGRVTITADESTSTAYMELSSLRSEDTAVYYCARQSDYGLPRGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSC

SEQ ID NO: 118 - protein, 684 aa, Artificial Sequence
  source: /note="Description of Artificial Sequence: Synthetic polypeptide"
QVQLVQSGAEVKKPGSSVKVSCKASGGTFSSYAISWVRQAPGQGLEWMGGIIPISGFANYAQKFQGRVTITADESTSTAYMELSSLRSEDTAVYYCAREGGHYYSGWPYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGGGGGSGGGGSGGGGSQVQLVQSGAEVKKPGSSVKVSCKASGGTFSSYAISWVRQAPGQGLEWMGGIIPISGFANYAQKFQGRVTITADESTSTAYMELSSLRSEDTAVYYCAREGGHYYSGWPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSC

SEQ ID NO: 119 - protein, 682 aa, Artificial Sequence
  source: /note="Description of Artificial Sequence: Synthetic polypeptide"
QVQLVQSGAEVKKPGSSVKVSCKASGGTFVRYAISWVRQAPGQGLEWMGGIIPIFGEAQYAQKFQGRVTITADESTSTAYMELSSLRSEDTAVYYCAREGYYYGALPYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGGGGGSGGGGSGGGGSQVQLVQSGAEVKKPGSSVKVSCKASGGTFVRYAISWVRQAPGQGLEWMGGIIPIFGEAQYAQKFQGRVTITADESTSTAYMELSSLRSEDTAVYYCAREGYYYGALPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSC

SEQ ID NO: 120 - protein, 696 aa, Artificial Sequence
  source: /note="Description of Artificial Sequence: Synthetic polypeptide"
QVQLQESGPGLVKPSETLSLTCAVSGYSISSEYMWGWIRQPPGKGLEWIGLIYHSGKTYYNPSLKSRVTISVDTSKNQFSLKLSSVTAADTAVYYCARDSGRGYGDYGGHHAFDIWGQGTMVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGGGGGSGGGGSGGGGSQVQLQESGPGLVKPSETLSLTCAVSGYSISSEYMWGWIRQPPGKGLEWIGLIYHSGKTYYNPSLKSRVTISVDTSKNQFSLKLSSVTAADTAVYYCARDSGRGYGDYGGHHAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSC

SEQ ID NO: 121 - protein, 698 aa, Artificial Sequence
  source: /note="Description of Artificial Sequence: Synthetic polypeptide"
QVQLQESGPGLVKPSQTLSLTCTVSGGSISSGGAVWSWIRQHPGKGLEWIGGIAYSGSTYYNPSLKSRVTISVDTSKNQFSLKLSSVTAADTAVYYCARDSVRGYGDYGGHHAFDIWGQGTMVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGGGGGSGGGGSGGGGSQVQLQESGPGLVKPSQTLSLTCTVSGGSISSGGAVWSWIRQHPGKGLEWIGGIAYSGSTYYNPSLKSRVTISVDTSKNQFSLKLSSVTAADTAVYYCARDSVRGYGDYGGHHAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSC

SEQ ID NO: 122 - protein, 686 aa, Artificial Sequence
  source: /note="Description of Artificial Sequence: Synthetic polypeptide"
QVQLQESGPGLVKPSETLSLTCAVSGYSISSEYMWGWIRQPPGKGLEWIGLIYHSGKTYYNPSLKSRVTISVDTSKNQFSLKLSSVTAADTAVYYCARDSGRGYGDYGGHHAFDIWGQGTMVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGGGGGSQVQLQESGPGLVKPSETLSLTCAVSGYSISSEYMWGWIRQPPGKGLEWIGLIYHSGKTYYNPSLKSRVTISVDTSKNQFSLKLSSVTAADTAVYYCARDSGRGYGDYGGHHAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSC

SEQ ID NO: 123 - protein, 688 aa, Artificial Sequence
  source: /note="Description of Artificial Sequence: Synthetic polypeptide"
QVQLQESGPGLVKPSQTLSLTCTVSGGSISSGGAVWSWIRQHPGKGLEWIGGIAYSGSTYYNPSLKSRVTISVDTSKNQFSLKLSSVTAADTAVYYCARDSVRGYGDYGGHHAFDIWGQGTMVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGGGGGSQVQLQESGPGLVKPSQTLSLTCTVSGGSISSGGAVWSWIRQHPGKGLEWIGGIAYSGSTYYNPSLKSRVTISVDTSKNQFSLKLSSVTAADTAVYYCARDSVRGYGDYGGHHAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSC

SEQ ID NO: 124 - protein, 672 aa, Artificial Sequence
  source: /note="Description of Artificial Sequence: Synthetic polypeptide"
QVQLVQSGAEVKKPGASVKVSCKASGYTFTSYYMHWVRQAPGQGLEWMGIINPSGGSTTYAQKFQGRVTMTRDTSTSTVYMELSSLRSEDTAVYYCARGQYGYYGGRLDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCGGGGSQVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCARDGLGYMAWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 125 - protein, 219 aa, Artificial Sequence
  source: /note="Description of Artificial Sequence: Synthetic polypeptide"
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPITFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 126 - protein, 121 aa, Artificial Sequence
  source: /note="Description of Artificial Sequence: Synthetic polypeptide"
QVQLVQSGAEVKKPGASVKVSCKASGYTFTSYYMHWVRQAPGQGLEWMGIINPSGGSTTYAQKFQGRVTMTRDTSTSTVYMELSSLRSEDTAVYYCARGQYGYYGGRLDVWGQGTTVTVSS

SEQ ID NO: 127 - protein, 116 aa, Artificial Sequence
  source: /note="Description of Artificial Sequence: Synthetic polypeptide"
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCARDGLGYMAWGQGTTVTVSS

SEQ ID NO: 128 - protein, 112 aa, Artificial Sequence
  source: /note="Description of Artificial Sequence: Synthetic polypeptide"
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPITFGGGTKVEIK

SEQ ID NO: 129 - protein, 9 aa, Artificial Sequence
  source: /note="Description of Artificial Sequence: Synthetic peptide"
YTFTSYYMH

SEQ ID NO: 130 - protein, 17 aa, Artificial Sequence
  source: /note="Description of Artificial Sequence: Synthetic peptide"
IINPSGGSTTYAQKFQG

SEQ ID NO: 131 - protein, 14 aa, Artificial Sequence
  source: /note="Description of Artificial Sequence: Synthetic peptide"
ARGQYGYYGGRLDV

SEQ ID NO: 132 - protein, 9 aa, Artificial Sequence
  source: /note="Description of Artificial Sequence: Synthetic peptide"
FTFSSYGMH

SEQ ID NO: 133 - protein, 17 aa, Artificial Sequence
  source: /note="Description of Artificial Sequence: Synthetic peptide"
VISYDGSNKYYADSVKG

SEQ ID NO: 134 - protein, 9 aa, Artificial Sequence
  source: /note="Description of Artificial Sequence: Synthetic peptide"
ARDGLGYMA

SEQ ID NO: 135 - protein, 9 aa, Artificial Sequence
  source: /note="Description of Artificial Sequence: Synthetic peptide"
MQALQTPIT

SEQ ID NO: 136 - protein, 672 aa, Artificial Sequence
  source: /note="Description of Artificial Sequence: Synthetic polypeptide"
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCARDGLGYMAWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKGGGGSQVQLVQSGAEVKKPGASVKVSCKASGYTFTSYYMHWVRQAPGQGLEWMGIINPSGGSTTYAQKFQGRVTMTRDTSTSTVYMELSSLRSEDTAVYYCARGQYGYYGGRLDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSC

SEQ ID NO: 137 - protein, 103 aa, Artificial Sequence
  source: /note="Description of Artificial Sequence: Synthetic polypeptide"
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSC

SEQ ID NO: 138 - protein, 327 aa, Artificial Sequence
  source: /note="Description of Artificial Sequence: Synthetic polypeptide"
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 139 - protein, 326 aa, Artificial Sequence
  source: /note="Description of Artificial Sequence: Synthetic polypeptide"
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 140 - protein, 107 aa, Artificial Sequence [sequence omitted]

SEQ ID NO: 141 - protein, 19 aa, Artificial Sequence
  source: /note="Description of Artificial Sequence: Synthetic peptide"
  VARIANT (1)..(1): /replace="Val"
  VARIANT (2)..(2): /replace="Asp" or "Leu" or "Arg"
  VARIANT (3)..(3): /replace="Asp"
  VARIANT (4)..(4): /replace="Asn" or "Ser" or "Ala"
  VARIANT (5)..(5): /replace="Asp" or "Gly"
  MISC_FEATURE (1)..(19): /note="Variant residues given in the sequence have no preference with respect to those in the annotations for variant positions"
AHERVRGYGDYGGHHAFDI

SEQ ID NO: 142 - protein, 16 aa, Artificial Sequence
  source: /note="Description of Artificial Sequence: Synthetic peptide"
  VARIANT (1)..(1): /replace="Leu" or "Ser"
  VARIANT (3)..(3): /replace="Ala" or "Val"
  VARIANT (4)..(4): /replace="Tyr" or "His"
  VARIANT (7)..(7): /replace="Lys"
  MISC_FEATURE (1)..(16): /note="Variant residues given in the sequence have no preference with respect to those in the annotations for variant positions"
GIYESGSTYYNPSLKS

SEQ ID NO: 143 - protein, 11 aa, Artificial Sequence
  source: /note="Description of Artificial Sequence: Synthetic peptide"
  VARIANT (1)..(1): /replace="Gly"
  VARIANT (6)..(6): /replace="Ser" or "Glu"
  VARIANT (7)..(7): /replace="Gly" or "Ser" or "Tyr" or "Ala"
  VARIANT (8)..(8): /replace="Ala" or "Tyr" or "Met"
  VARIANT (9)..(9): /replace="Ala" or " "
  VARIANT (11)..(11): /replace="Gly"
  MISC_FEATURE (1)..(11): /note="Variant residues given in the sequence have no preference with respect to those in the annotations for variant positions"
YSISSGLGVWS

SEQ ID NO: 144 - protein, 9 aa, Artificial Sequence
  source: /note="Description of Artificial Sequence: Synthetic peptide"
  VARIANT (5)..(5): /replace="Asn"
  VARIANT (9)..(9): /replace="Ser"
  MISC_FEATURE (1)..(9): /note="Variant residues given in the sequence have no preference with respect to those in the annotations for variant positions"
QQEYATPPT

SEQ ID NO: 145 - protein, 7 aa, Artificial Sequence
  source: /note="Description of Artificial Sequence: Synthetic peptide"
  VARIANT (1)..(1): /replace="Ser"
  VARIANT (3)..(3): /replace="Ser"
  VARIANT (6)..(6): /replace="Asp" or "Lys" or "Glu"
  VARIANT (7)..(7): /replace="Tyr"
  MISC_FEATURE (1)..(7): /note="Variant residues given in the sequence have no preference with respect to those in the annotations for variant positions"
AADSLQS

SEQ ID NO: 146 - protein, 11 aa, Artificial Sequence
  source: /note="Description of Artificial Sequence: Synthetic peptide"
  VARIANT (1)..(1): /replace="Arg"
  VARIANT (4)..(4): /replace="Lys"
  VARIANT (7)..(7): /replace="Asp" or "Asn"
  VARIANT (8)..(8): /replace="Thr"
  MISC_FEATURE (1)..(11): /note="Variant residues given in the sequence have no preference with respect to those in the annotations for variant positions"
GASQSISSYLN

SEQ ID NO: 147 - protein, 17 aa, Artificial Sequence
  source: /note="Description of Artificial Sequence: Synthetic peptide"
  VARIANT (14)..(14): /replace="Arg"
  VARIANT (16)..(16): /replace="Arg"
  MISC_FEATURE (1)..(17): /note="Variant residues given in the sequence have no preference with respect to those in the annotations for variant positions"
GIIPIFGEAQYAQKFQG

SEQ ID NO: 148 - protein, 456 aa, Artificial Sequence
  source: /note="Description of Artificial Sequence: Synthetic polypeptide"
QVQLQESGPGLVKPSETLSLTCAVSGYSISSGLGWGWIRQPPGKGLEWIGGIYESGSTYYNPSLKSRVTISVDTSKNQFSLKLSSVTAADTAVYYCAHERVRGYGDYGGHHAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 149 - protein, 457 aa, Artificial Sequence
  source: /note="Description of Artificial Sequence: Synthetic polypeptide"
QVQLQESGPGLVKPSQTLSLTCTVSGGSISSGGAVWSWIRQHPGKGLEWIGGIAYSGSTYYNPSLKSRVTISVDTSKNQFSLKLSSVTAADTAVYYCADENVRGYGDYGGHHAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 150 - protein, 456 aa, Artificial Sequence
  source: /note="Description of Artificial Sequence: Synthetic polypeptide"
QVQLQESGPGLVKPSETLSLTCAVSGYSISSGAGWGWIRQPPGKGLEWIGLIVHSGSTYYNPSLKSRVTISVDTSKNQFSLKLSSVTAADTAVYYCVLESVRGYGDYGGHHAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 151 - protein, 456 aa, Artificial Sequence
  source: /note="Description of Artificial Sequence: Synthetic polypeptide"
QVQLQESGPGLVKPSETLSLTCAVSGYSISSGAGWGWIRQPPGKGPEWIGLIVHSGSTYYNPSLKSRVTISVDTSKNQFSLKLSSVTAADTAVYYCVLESVRGYGDYGGHHAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 152 - protein, 456 aa, Artificial Sequence; identical to SEQ ID NO: 150
  source: /note="Description of Artificial Sequence: Synthetic polypeptide"

SEQ ID NO: 153 - protein, 456 aa, Artificial Sequence
  source: /note="Description of Artificial Sequence: Synthetic polypeptide"
QVQLQESGPGLVKPSETLSLTCAVSGYSISSEYMWGWIRQPPGKGLEWIGLIYHSGKTYYNPSLKSRVTISVDTSKNQFSLKLSSVTAADTAVYYCAREADRGYGDYGGHHAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 154 - protein, 456 aa, Artificial Sequence; identical to SEQ ID NO: 153
  source: /note="Description of Artificial Sequence: Synthetic polypeptide"

SEQ ID NO: 155 - protein, 457 aa, Artificial Sequence
  source: /note="Description of Artificial Sequence: Synthetic polypeptide"
QLQLQESGPGLVKPSETLSLTCTVSGGSISSSSYAWGWIRQPPGKGLEWIGSIYYSGSTYYNPSLKSRVTISVDTSKNQFSLKLSSVTAADTAVYYCARDSGRGYGDYGGHHAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 156 - protein, 454 aa, Artificial Sequence
  source: /note="Description of Artificial Sequence: Synthetic polypeptide"
QLQLQESGPGLVKPSETLSLTCTVSGGSISSSSYAWGWIRQPPGKGLEWIGSIYYSGSTYYNPSLKSRVTISVDTSKNQFSLKLSSVTAADTAVYYCARDSGRGYGDYGGHHAFDIWGQGTMVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 157 - protein, 455 aa, Artificial Sequence
  source: /note="Description of Artificial Sequence: Synthetic polypeptide"
QVQLVQSGAEVKKPGSSVKVSCKASGGTFSSYYISWVRQAPGQGLEWMGGIIPVPGTANYAQKFQGRVTITADESTSTAYMELSSLRSEDTAVYYCARAGGGYARGDHYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 158 - protein, 451 aa, Artificial Sequence
  source: /note="Description of Artificial Sequence: Synthetic polypeptide"
QVQLVQSGAEVKKPGSSVKVSCKASGGTFSRGAISWVRQAPGQGLEWMGGIIPIEGTAYYAQKFQGRVTITADESTSTAYMELSSLRSEDTAVYYCARQSDYGLPRGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 159 - protein, 450 aa, Artificial Sequence
  source: /note="Description of Artificial Sequence: Synthetic polypeptide"
QVQLVQSGAEVKKPGSSVKVSCKASGGTFSSYAISWVRQAPGQGLEWMGGIIPISGFANYAQKFQGRVTITADESTSTAYMELSSLRSEDTAVYYCAREGGHYYSGWPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 160 - protein, 449 aa, Artificial Sequence
  source: /note="Description of Artificial Sequence: Synthetic polypeptide"
QVQLVQSGAEVKKPGSSVKVSCKASGGTFVRYAISWVRQAPGQGLEWMGGIIPIFGEAQYAQKFQGRVTITADESTSTAYMELSSLRSEDTAVYYCAREGYYYGALPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 161 - protein, 456 aa, Artificial Sequence
  source: /note="Description of Artificial Sequence: Synthetic polypeptide"
QVQLQESGPGLVKPSETLSLTCAVSGYSISSEYMWGWIRQPPGKGLEWIGLIYHSGKTYYNPSLKSRVTISVDTSKNQFSLKLSSVTAADTAVYYCARDSGRGYGDYGGHHAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 162 - protein, 457 aa, Artificial Sequence
  source: /note="Description of Artificial Sequence: Synthetic polypeptide"
QVQLQESGPGLVKPSQTLSLTCTVSGGSISSGGAVWSWIRQHPGKGLEWIGGIAYSGSTYYNPSLKSRVTISVDTSKNQFSLKLSSVTAADTAVYYCARDSVRGYGDYGGHHAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 163 - protein, 685 aa, Artificial Sequence
  source: /note="Description of Artificial Sequence: Synthetic polypeptide"
QVQLVQSGAEVKRPGSSVKVSCKASGGTFSSYYISWVRQVPGQGLEWMGGIIPVPGTANYAQKFQGRVTITADESTSTAYMELSSLRSEDTAVYYCARAGGGYARGDHYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCGGGGSQVQLVQSGAEVKRPGSSVKVSCKASGGTFSSYYISWVRQVPGQGLEWMGGIIPVPGTANYAQKFQGRVTITADESTSTAYMELSSLRSEDTAVYYCARAGGGYARGDHYYGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 164 - protein, 685 aa, Artificial Sequence
  source: /note="Description of Artificial Sequence: Synthetic polypeptide"
QVQLVQSGAEVKKPGSSVKVSCKASGGTFSSYYISWVRQAPGQRLEWMGGIIPVPGTANYAQKFQGRVTITADESTSTAYMELSSLRSEDTAVYYCARAGGGYARGDHYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCGGGGSQVQLVQSGAEVKKPGSSVKVSCKASGGTFSSYYISWVRQAPGQRLEWMGGIIPVPGTANYAQKFQGRVTITADESTSTAYMELSSLRSEDTAVYYCARAGGGYARGDHYYGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 165 - protein, 677 aa, Artificial Sequence
  source: /note="Description of Artificial Sequence: Synthetic polypeptide"
QVQLVQSGAEVKKPGSSVKVSCKASGGTFSRGAISWVRQAPGQGLEWMGGIIPIEGTAYYAQKFQGRVTITADESTGTAYMELSSLRSEDTAVYYCARQSDYGLPRGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCGGGGSQVQLVQSGAEVKKPGSSVKVSCKASGGTFSRGAISWVRQAPGQGLEWMGGIIPIEGTAYYAQKFQGRVTITADESTGTAYMELSSLRSEDTAVYYCARQSDYGLPRGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 166 - protein, 675 aa, Artificial Sequence
  source: /note="Description of Artificial Sequence: Synthetic polypeptide"
QVQLVQSGAEVKKPGSSVKVSCKASGGTFSSYAISWVRQAPGQGLEWMGGIIPISGFTNYAQKFQGRVTITADESTSTAYMELSSLRSEDTAVYYCAREGGHYYSGWPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCGGGGSQVQLVQSGAEVKKPGSSVKVSCKASGGTFSSYAISWVRQAPGQGLEWMGGIIPISGFTNYAQKFQGRVTITADESTSTAYMELSSLRSEDTAVYYCAREGGHYYSGWPYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 167 - protein, 675 aa, Artificial Sequence
  source: /note="Description of Artificial Sequence: Synthetic polypeptide"
QVQLVQSGAEVKKPGSSVKVSCKASGGTFSSYAISWVRQAPGQRLEWMGGIIPISGFTNYAQKFQGRVTITADESTSTAYMELSSLRSEDTAVYYCAREGGHYYSGWPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCGGGGSQVQLVQSGAEVKKPGSSVKVSCKASGGTFSSYAISWVRQAPGQRLEWMGGIIPISGFTNYAQKFQGRVTITADESTSTAYMELSSLRSEDTAVYYCAREGGHYYSGWPYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 168 - protein, 675 aa, Artificial Sequence
  source: /note="Description of Artificial Sequence: Synthetic polypeptide"
QVQLVQSGAEVKKPGSSVKVSCKASGGTFSSYAISWVRQAPGQGLEWMGGIIPISGFTNYAQKFQGKVTITADESTSTAYMELSSLRSEDTAVYYCAREGGHYYSGWPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCGGGGSQVQLVQSGAEVKKPGSSVKVSCKASGGTFSSYAISWVRQAPGQGLEWMGGIIPISGFTNYAQKFQGKVTITADESTSTAYMELSSLRSEDTAVYYCAREGGHYYSGWPYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 169 - protein, 673 aa, Artificial Sequence
  source: /note="Description of Artificial Sequence: Synthetic polypeptide"
QVQLVQSGAEVKKPGSSVKVSCKASGGTFVRYAISWVRQAPGQGLEWMGGIIPIFGEAQYAQRFQGRVTITADESTSTAYMELSSLRSEDTAVYYCAREGYYYGALPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCGGGGSQVQLVQSGAEVKKPGSSVKVSCKASGGTFVRYAISWVRQAPGQGLEWMGGIIPIFGEAQYAQRFQGRVTITADESTSTAYMELSSLRSEDTAVYYCAREGYYYGALPYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 170 - protein, 673 aa, Artificial Sequence
  source: /note="Description of Artificial Sequence: Synthetic polypeptide"
QVQLVQSGAEVKKPGSSVKVSCKASGGTFVRYAISWVRQAPGQGLEWMGGIIPIFGEAQYAQKFRGRATITADESTSTAYMELSSLRSEDTAVYYCAREGYYYGALPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCGGGGSQVQLVQSGAEVKKPGSSVKVSCKASGGTFVRYAISWVRQAPGQGLEWMGGIIPIFGEAQYAQKFRGRATITADESTSTAYMELSSLRSEDTAVYYCAREGYYYGALPYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 171 - protein, 455 aa, Artificial Sequence
  source: /note="Description of Artificial Sequence: Synthetic polypeptide"
QVQLVQSGAEVKRPGSSVKVSCKASGGTFSSYYISWVRQVPGQGLEWMGGIIPVPGTANYAQKFQGRVTITADESTSTAYMELSSLRSEDTAVYYCARAGGGYARGDHYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 172 - protein, 455 aa, Artificial Sequence
  source: /note="Description of Artificial Sequence: Synthetic polypeptide"
QVQLVQSGAEVKKPGSSVKVSCKASGGTFSSYYISWVRQAPGQRLEWMGGIIPVPGTANYAQKFQGRVTITADESTSTAYMELSSLRSEDTAVYYCARAGGGYARGDHYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 173 - protein, 451 aa, Artificial Sequence
  source: /note="Description of Artificial Sequence: Synthetic polypeptide"
QVQLVQSGAEVKKPGSSVKVSCKASGGTFSRGAISWVRQAPGQGLEWMGGIIPIEGTAYYAQKFQGRVTITADESTGTAYMELSSLRSEDTAVYYCARQSDYGLPRGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 174 - protein, 450 aa, Artificial Sequence
  source: /note="Description of Artificial Sequence: Synthetic polypeptide"
QVQLVQSGAEVKKPGSSVKVSCKASGGTFSSYAISWVRQAPGQGLEWMGGIIPISGFTNYAQKFQGRVTITADESTSTAYMELSSLRSEDTAVYYCAREGGHYYSGWPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 175 - protein, 450 aa, Artificial Sequence
  source: /note="Description of Artificial Sequence: Synthetic polypeptide"
QVQLVQSGAEVKKPGSSVKVSCKASGGTFSSYAISWVRQAPGQRLEWMGGIIPISGFTNYAQKFQGRVTITADESTSTAYMELSSLRSEDTAVYYCAREGGHYYSGWPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 176 - protein, 450 aa, Artificial Sequence
  source: /note="Description of Artificial Sequence: Synthetic polypeptide"
QVQLVQSGAEVKKPGSSVKVSCKASGGTFSSYAISWVRQAPGQGLEWMGGIIPISGFTNYAQKFQGKVTITADESTSTAYMELSSLRSEDTAVYYCAREGGHYYSGWPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 177 - protein, 449 aa, Artificial Sequence
  source: /note="Description of Artificial Sequence: Synthetic polypeptide"
QVQLVQSGAEVKKPGSSVKVSCKASGGTFVRYAISWVRQAPGQGLEWMGGIIPIFGEAQYAQRFQGRVTITADESTSTAYMELSSLRSEDTAVYYCAREGYYYGALPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 178 - protein, 449 aa, Artificial Sequence
  source: /note="Description of Artificial Sequence: Synthetic polypeptide"
QVQLVQSGAEVKKPGSSVKVSCKASGGTFVRYAISWVRQAPGQGLEWMGGIIPIFGEAQYAQKFRGRATITADESTSTAYMELSSLRSEDTAVYYCAREGYYYGALPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 179 - protein, 451 aa, Artificial Sequence
  source: /note="Description of Artificial Sequence: Synthetic polypeptide"
QVQLVQSGAEVKKPGASVKVSCKASGYTFTSYYMHWVRQAPGQGLEWMGIINPSGGSTTYAQKFQGRVTMTRDTSTSTVYMELSSLRSEDTAVYYCARGQYGYYGGRLDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 180 - protein, 448 aa, Artificial Sequence
  source: /note="Description of Artificial Sequence: Synthetic polypeptide"
QVQLVQSGAEVKKPGASVKVSCKASGYTFTSYYMHWVRQAPGQGLEWMGIINPSGGSTTYAQKFQGRVTMTRDTSTSTVYMELSSLRSEDTAVYYCARGQYGYYGGRLDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 181 - protein, 446 aa, Artificial Sequence
  source: /note="Description of Artificial Sequence: Synthetic polypeptide"
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCARDGLGYMAWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 182 - protein, 443 aa, Artificial Sequence
  source: /note="Description of Artificial Sequence: Synthetic polypeptide"
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCARDGLGYMAWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 183 - protein, 690 aa, Artificial Sequence
  source: /note="Description of Artificial Sequence: Synthetic polypeptide"
QVQLQESGPGLVKPSETLSLTCAVSGYSISSGLGWGWIRQPPGKGLEWIGGIYESGSTYYNPSLKSRVTISVDTSKNQFSLKLSSVTAADTAVYYCAHERVRGYGDYGGHHAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCGGGGSQVQLQESGPGLVKPSETLSLTCAVSGYSISSGLGWGWIRQPPGKGLEWIGGIYESGSTYYNPSLKSRVTISVDTSKNQFSLKLSSVTAADTAVYYCAHERVRGYGDYGGHHAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 184 - protein, 692 aa, Artificial Sequence
  source: /note="Description of Artificial Sequence: Synthetic polypeptide"
QVQLQESGPGLVKPSQTLSLTCTVSGGSISSGGAVWSWIRQHPGKGLEWIGGIAYSGSTYYNPSLKSRVTISVDTSKNQFSLKLSSVTAADTAVYYCADENVRGYGDYGGHHAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCGGGGSQVQLQESGPGLVKPSQTLSLTCTVSGGSISSGGAVWSWIRQHPGKGLEWIGGIAYSGSTYYNPSLKSRVTISVDTSKNQFSLKLSSVTAADTAVYYCADENVRGYGDYGGHHAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 185 - protein, 690 aa, Artificial Sequence
  source: /note="Description of Artificial Sequence: Synthetic polypeptide"
QVQLQESGPGLVKPSETLSLTCAVSGYSISSGAGWGWIRQPPGKGLEWIGLIVHSGSTYYNPSLKSRVTISVDTSKNQFSLKLSSVTAADTAVYYCVLESVRGYGDYGGHHAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCGGGGSQVQLQESGPGLVKPSETLSLTCAVSGYSISSGAGWGWIRQPPGKGLEWIGLIVHSGSTYYNPSLKSRVTISVDTSKNQFSLKLSSVTAADTAVYYCVLESVRGYGDYGGHHAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 186 - protein, 690 aa, Artificial Sequence
  source: /note="Description of Artificial Sequence: Synthetic polypeptide"
QVQLQESGPGLVKPSETLSLTCAVSGYSISSGAGWGWIRQPPGKGPEWIGLIVHSGSTYYNPSLKSRVTISVDTSKNQFSLKLSSVTAADTAVYYCVLESVRGYGDYGGHHAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCGGGGSQVQLQESGPGLVKPSETLSLTCAVSGYSISSGAGWGWIRQPPGKGPEWIGLIVHSGSTYYNPSLKSRVTISVDTSKNQFSLKLSSVTAADTAVYYCVLESVRGYGDYGGHHAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 187 - protein, 690 aa, Artificial Sequence; identical to SEQ ID NO: 185
  source: /note="Description of Artificial Sequence: Synthetic polypeptide"

SEQ ID NO: 188 - protein, 690 aa, Artificial Sequence; identical to SEQ ID NO: 185
  source: /note="Description of Artificial Sequence: Synthetic polypeptide"

SEQ ID NO: 189 - protein, 690 aa, Artificial Sequence
  source: /note="Description of Artificial Sequence: Synthetic polypeptide"
QVQLQESGPGLVKPSETLSLTCAVSGYSISSEYMWGWIRQPPGKGLEWIGLIYHSGKTYYNPSLKSRVTISVDTSKNQFSLKLSSVTAADTAVYYCAREADRGYGDYGGHHAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCGGGGSQVQLQESGPGLVKPSETLSLTCAVSGYSISSEYMWGWIRQPPGKGLEWIGLIYHSGKTYYNPSLKSRVTISVDTSKNQFSLKLSSVTAADTAVYYCAREADRGYGDYGGHHAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 190 - protein, 690 aa, Artificial Sequence; identical to SEQ ID NO: 189
  source: /note="Description of Artificial Sequence: Synthetic polypeptide"

SEQ ID NO: 191 - protein, 690 aa, Artificial Sequence
  source: /note="Description of Artificial Sequence: Synthetic polypeptide"
QVQLQESGPGLVKPSETLSLTCAVSGYSISSGLGWGWIRQPPGKGLEWIGGIYESGSTYYNPSLKSRVTISVDTSKNQFSLKLSSVTAADTAVYYCAHERVRGYGDYGGHHAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSQVQLQESGPGLVKPSETLSLTCAVSGYSISSGLGWGWIRQPPGKGLEWIGGIYESGSTYYNPSLKSRVTISVDTSKNQFSLKLSSVTAADTAVYYCAHERVRGYGDYGGHHAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSC

SEQ ID NO: 192 - protein, 692 aa, Artificial Sequence
  source: /note="Description of Artificial Sequence: Synthetic polypeptide"
QVQLQESGPGLVKPSQTLSLTCTVSGGSISSGGAVWSWIRQHPGKGLEWIGGIAYSGSTYYNPSLKSRVTISVDTSKNQFSLKLSSVTAADTAVYYCADENVRGYGDYGGHHAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSQVQLQESGPGLVKPSQTLSLTCTVSGGSISSGGAVWSWIRQHPGKGLEWIGGIAYSGSTYYNPSLKSRVTISVDTSKNQFSLKLSSVTAADTAVYYCADENVRGYGDYGGHHAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSC

SEQ ID NO: 193 - protein, 690 aa, Artificial Sequence
  source: /note="Description of Artificial Sequence: Synthetic polypeptide"
QVQLQESGPGLVKPSETLSLTCAVSGYSISSGAGWGWIRQPPGKGLEWIGLIVHSGSTYYNPSLKSRVTISVDTSKNQFSLKLSSVTAADTAVYYCVLESVRGYGDYGGHHAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSQVQLQESGPGLVKPSETLSLTCAVSGYSISSGAGWGWIRQPPGKGLEWIGLIVHSGSTYYNPSLKSRVTISVDTSKNQFSLKLSSVTAADTAVYYCVLESVRGYGDYGGHHAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSC

SEQ ID NO: 194 - protein, 690 aa, Artificial Sequence
  source: /note="Description of Artificial Sequence: Synthetic polypeptide"
QVQLQESGPGLVKPSETLSLTCAVSGYSISSGAGWGWIRQPPGKGPEWIGLIVHSGSTYYNPSLKSRVTISVDTSKNQFSLKLSSVTAADTAVYYCVLESVRGYGDYGGHHAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSQVQLQESGPGLVKPSETLSLTCAVSGYSISSGAGWGWIRQPPGKGPEWIGLIVHSGSTYYNPSLKSRVTISVDTSKNQFSLKLSSVTAADTAVYYCVLESVRGYGDYGGHHAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSC

SEQ ID NO: 195 - protein, 690 aa, Artificial Sequence; identical to SEQ ID NO: 193
  source: /note="Description of Artificial Sequence: Synthetic polypeptide"

SEQ ID NO: 196 - protein, 690 aa, Artificial Sequence; identical to SEQ ID NO: 193
  source: /note="Description of Artificial Sequence: Synthetic polypeptide"

SEQ ID NO: 197 - protein, 690 aa, Artificial Sequence
  source: /note="Description of Artificial Sequence: Synthetic polypeptide"
QVQLQESGPGLVKPSETLSLTCAVSGYSISSEYMWGWIRQPPGKGLEWIGLIYHSGKTYYNPSLKSRVTISVDTSKNQFSLKLSSVTAADTAVYYCAREADRGYGDYGGHHAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSQVQLQESGPGLVKPSETLSLTCAVSGYSISSEYMWGWIRQPPGKGLEWIGLIYHSGKTYYNPSLKSRVTISVDTSKNQFSLKLSSVTAADTAVYYCAREADRGYGDYGGHHAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSC

SEQ ID NO: 198 - protein, 690 aa, Artificial Sequence; identical to SEQ ID NO: 197
  source: /note="Description of Artificial Sequence: Synthetic polypeptide"

SEQ ID NO: 199 - protein, 688 aa, Artificial Sequence
  source: /note="Description of Artificial Sequence: Synthetic polypeptide"
QVQLVQSGAEVKRPGSSVKVSCKASGGTFSSYYISWVRQVPGQGLEWMGGIIPVPGTANYAQKFQGRVTITADESTSTAYMELSSLRSEDTAVYYCARAGGGYARGDHYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCGGGGSQVQLVQSGAEVKRPGSSVKVSCKASGGTFSSYYISWVRQVPGQGLEWMGGIIPVPGTANYAQKFQGRVTITADESTSTAYMELSSLRSEDTAVYYCARAGGGYARGDHYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 200 - protein, 688 aa, Artificial Sequence
  source: /note="Description of Artificial Sequence: Synthetic polypeptide"
QVQLVQSGAEVKKPGSSVKVSCKASGGTFSSYYISWVRQAPGQRLEWMGGIIPVPGTANYAQKFQGRVTITADESTSTAYMELSSLRSEDTAVYYCARAGGGYARGDHYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCGGGGSQVQLVQSGAEVKKPGSSVKVSCKASGGTFSSYYISWVRQAPGQRLEWMGGIIPVPGTANYAQKFQGRVTITADESTSTAYMELSSLRSEDTAVYYCARAGGGYARGDHYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 201 - protein, 680 aa, Artificial Sequence
  source: /note="Description of Artificial Sequence: Synthetic polypeptide"
QVQLVQSGAEVKKPGSSVKVSCKASGGTFSRGAISWVRQAPGQGLEWMGGIIPIEGTAYYAQKFQGRVTITADESTGTAYMELSSLRSEDTAVYYCARQSDYGLPRGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCGGGGSQVQLVQSGAEVKKPGSSVKVSCKASGGTFSRGAISWVRQAPGQGLEWMGGIIPIEGTAYYAQKFQGRVTITADESTGTAYMELSSLRSEDTAVYYCARQSDYGLPRGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 202 - protein, 678 aa, Artificial Sequence
  source: /note="Description of Artificial Sequence: Synthetic polypeptide"
QVQLVQSGAEVKKPGSSVKVSCKASGGTFSSYAISWVRQAPGQGLEWMGGIIPISGFTNYAQKFQGRVTITADESTSTAYMELSSLRSEDTAVYYCAREGGHYYSGWPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCGGGGSQVQLVQSGAEVKKPGSSVKVSCKASGGTFSSYAISWVRQAPGQGLEWMGGIIPISGFTNYAQKFQGRVTITADESTSTAYMELSSLRSEDTAVYYCAREGGHYYSGWPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 203 - protein, 678 aa, Artificial Sequence
  source: /note="Description of Artificial Sequence: Synthetic polypeptide"
QVQLVQSGAEVKKPGSSVKVSCKASGGTFSSYAISWVRQAPGQRLEWMGGIIPISGFTNYAQKFQGRVTITADESTSTAYMELSSLRSEDTAVYYCAREGGHYYSGWPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCGGGGSQVQLVQSGAEVKKPGSSVKVSCKASGGTFSSYAISWVRQAPGQRLEWMGGIIPISGFTNYAQKFQGRVTITADESTSTAYMELSSLRSEDTAVYYCAREGGHYYSGWPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 204 - protein, 678 aa, Artificial Sequence
  source: /note="Description of Artificial Sequence: Synthetic polypeptide"
QVQLVQSGAEVKKPGSSVKVSCKASGGTFSSYAISWVRQAPGQGLEWMGGIIPISGFTNYAQKFQGKVTITADESTSTAYMELSSLRSEDTAVYYCAREGGHYYSGWPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCGGGGSQVQLVQSGAEVKKPGSSVKVSCKASGGTFSSYAISWVRQAPGQGLEWMGGIIPISGFTNYAQKFQGKVTITADESTSTAYMELSSLRSEDTAVYYCAREGGHYYSGWPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 205 - protein, 676 aa, Artificial Sequence
  source: /note="Description of Artificial Sequence: Synthetic polypeptide"
QVQLVQSGAEVKKPGSSVKVSCKASGGTFVRYAISWVRQAPGQGLEWMGGIIPIFGEAQYAQRFQGRVTITADESTSTAYMELSSLRSEDTAVYYCAREGYYYGALPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCGGGGSQVQLVQSGAEVKKPGSSVKVSCKASGGTFVRYAISWVRQAPGQGLEWMGGIIPIFGEAQYAQRFQGRVTITADESTSTAYMELSSLRSEDTAVYYCAREGYYYGALPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 206 - protein, 676 aa, Artificial Sequence
  source: /note="Description of Artificial Sequence: Synthetic polypeptide"
QVQLVQSGAEVKKPGSSVKVSCKASGGTFVRYAISWVRQAPGQGLEWMGGIIPIFGEAQYAQKFRGRATITADESTSTAYMELSSLRSEDTAVYYCAREGYYYGALPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCGGGGSQVQLVQSGAEVKKPGSSVKVSCKASGGTFVRYAISWVRQAPGQGLEWMGGIIPIFGEAQYAQKFRGRATITADESTSTAYMELSSLRSEDTAVYYCAREGYYYGALPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 207 - protein, 688 aa, Artificial Sequence
  source: /note="Description of Artificial Sequence: Synthetic polypeptide"
QVQLVQSGAEVKRPGSSVKVSCKASGGTFSSYYISWVRQVPGQGLEWMGGIIPVPGTANYAQKFQGRVTITADESTSTAYMELSSLRSEDTAVYYCARAGGGYARGDHYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSQVQLVQSGAEVKRPGSSVKVSCKASGGTFSSYYISWVRQVPGQGLEWMGGIIPVPGTANYAQKFQGRVTITADESTSTAYMELSSLRSEDTAVYYCARAGGGYARGDHYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSC

SEQ ID NO: 208 - protein, 688 aa, Artificial Sequence
  source: /note="Description of Artificial Sequence: Synthetic polypeptide"
QVQLVQSGAEVKKPGSSVKVSCKASGGTFSSYYISWVRQAPGQRLEWMGGIIPVPGTANYAQKFQGRVTITADESTSTAYMELSSLRSEDTAVYYCARAGGGYARGDHYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSQVQLVQSGAEVKKPGSSVKVSCKASGGTFSSYYISWVRQAPGQRLEWMGGIIPVPGTANYAQKFQGRVTITADESTSTAYMELSSLRSEDTAVYYCARAGGGYARGDHYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSC

SEQ ID NO: 209 - protein, 680 aa, Artificial Sequence
  source: /note="Description of Artificial Sequence: Synthetic polypeptide"
QVQLVQSGAEVKKPGSSVKVSCKASGGTFSRGAISWVRQAPGQGLEWMGGIIPIEGTAYYAQKFQGRVTITADESTGTAYMELSSLRSEDTAVYYCARQSDYGLPRGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSQVQLVQSGAEVKKPGSSVKVSCKASGGTFSRGAISWVRQAPGQGLEWMGGIIPIEGTAYYAQKFQGRVTITADESTGTAYMELSSLRSEDTAVYYCARQSDYGLPRGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSC

SEQ ID NO: 210 - protein, 678 aa, Artificial Sequence
  source: /note="Description of Artificial Sequence: Synthetic polypeptide"
QVQLVQSGAEVKKPGSSVKVSCKASGGTFSSYAISWVRQAPGQGLEWMGGIIPISGFTNYAQKFQGRVTITADESTSTAYMELSSLRSEDTAVYYCAREGGHYYSGWPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSQVQLVQSGAEVKKPGSSVKVSCKASGGTFSSYAISWVRQAPGQGLEWMGGIIPISGFTNYAQKFQGRVTITADESTSTAYMELSSLRSEDTAVYYCAREGGHYYSGWPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSC

SEQ ID NO: 211 - protein, 678 aa, Artificial Sequence
  source: /note="Description of Artificial Sequence: Synthetic polypeptide"
QVQLVQSGAEVKKPGSSVKVSCKASGGTFSSYAISWVRQAPGQRLEWMGGIIPISGFTNYAQKFQGRVTITADESTSTAYMELSSLRSEDTAVYYCAREGGHYYSGWPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSQVQLVQSGAEVKKPGSSVKVSCKASGGTFSSYAISWVRQAPGQRLEWMGGIIPISGFTNYAQKFQGRVTITADESTSTAYMELSSLRSEDTAVYYCAREGGHYYSGWPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSC

SEQ ID NO: 212 - protein, 678 aa, Artificial Sequence
  source: /note="Description of Artificial Sequence: Synthetic polypeptide"
QVQLVQSGAEVKKPGSSVKVSCKASGGTFSSYAISWVRQAPGQGLEWMGGIIPISGFTNYAQKFQGKVTITADESTSTAYMELSSLRSEDTAVYYCAREGGHYYSGWPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSQVQLVQSGAEVKKPGSSVKVSCKASGGTFSSYAISWVRQAPGQGLEWMGGIIPISGFTNYAQKFQGKVTITADESTSTAYMELSSLRSEDTAVYYCAREGGHYYSGWPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSC

SEQ ID NO: 213 - protein, 676 aa, Artificial Sequence
  source: /note="Description of Artificial Sequence: Synthetic polypeptide"
QVQLVQSGAEVKKPGSSVKVSCKASGGTFVRYAISWVRQAPGQGLEWMGGIIPIFGEAQYAQRFQGRVTITADESTSTAYMELSSLRSEDTAVYYCAREGYYYGALPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSQVQLVQSGAEVKKPGSSVKVSCKASGGTFVRYAISWVRQAPGQGLEWMGGIIPIFGEAQYAQRFQGRVTITADESTSTAYMELSSLRSEDTAVYYCAREGYYYGALPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSC

SEQ ID NO: 214 - protein, 676 aa, Artificial Sequence
  source: /note="Description of Artificial Sequence: Synthetic polypeptide"
QVQLVQSGAEVKKPGSSVKVSCKASGGTFVRYAISWVRQAPGQGLEWMGGIIPIFGEAQYAQKFRGRATITADESTSTAYMELSSLRSEDTAVYYCAREGYYYGALPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSQVQLVQSGAEVKKPGSSVKVSCKASGGTFVRYAISWVRQAPGQGLEWMGGIIPIFGEAQYAQKFRGRATITADESTSTAYMELSSLRSEDTAVYYCAREGYYYGALPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSC

SEQ ID NO: 215 - protein, 17 aa, Artificial Sequence
  source: /note="Description of Artificial Sequence: Synthetic peptide"
  VARIANT (14)..(14): /replace="Arg"
  VARIANT (16)..(16): /replace="Arg"
  MISC_FEATURE (1)..(17): /note="Variant residues given in the sequence have no preference with respect to those in the annotations for variant positions"
GIIPIFGEAQYAQKFQG

SEQ ID NO: 216 - protein, 675 aa, Artificial Sequence
  source: /note="Description of Artificial Sequence: Synthetic polypeptide"
QVQLVQSGAEVKKPGSSVKVSCKASGGTFSSYAISWVRQAPGQRLEWMGGIIPISGFTNYAQKFQGRVTITADESTSTAYMELSSLRSEDTAVYYCAREGGHYYSGWPYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKGGGGSQVQLVQSGAEVKKPGSSVKVSCKASGGTFSSYAISWVRQAPGQRLEWMGGIIPISGFTNYAQKFQGRVTITADESTSTAYMELSSLRSEDTAVYYCAREGGHYYSGWPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSC

SEQ ID NO: 217 - protein, 675 aa, Artificial Sequence
  source: /note="Description of Artificial Sequence: Synthetic polypeptide"
QVQLVQSGAEVKKPGSSVKVSCKASGGTFSSYAISWVRQAPGQGLEWMGGIIPISGFTNYAQKFQGKVTITADESTSTAYMELSSLRSEDTAVYYCAREGGHYYSGWPYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKGGGGSQVQLVQSGAEVKKPGSSVKVSCKASGGTFSSYAISWVRQAPGQGLEWMGGIIPISGFTNYAQKFQGKVTITADESTSTAYMELSSLRSEDTAVYYCAREGGHYYSGWPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSC

SEQ ID NO: 218 - protein, 673 aa, Artificial Sequence
  source: /note="Description of Artificial Sequence: Synthetic polypeptide"
QVQLVQSGAEVKKPGSSVKVSCKASGGTFVRYAISWVRQAPGQGLEWMGGIIPIFGEAQYAQRFQGRVTITADESTSTAYMELSSLRSEDTAVYYCAREGYYYGALPYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKGGGGSQVQLVQSGAEVKKPGSSVKVSCKASGGTFVRYAISWVRQAPGQGLEWMGGIIPIFGEAQYAQRFQGRVTITADESTSTAYMELSSLRSEDTAVYYCAREGYYYGALPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSC

SEQ ID NO: 219 - protein, 673 aa, Artificial Sequence
  source: /note="Description of Artificial Sequence: Synthetic polypeptide"
QVQLVQSGAEVKKPGSSVKVSCKASGGTFVRYAISWVRQAPGQGLEWMGGIIPIFGEAQYAQKFRGRATITADESTSTAYMELSSLRSEDTAVYYCAREGYYYGALPYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKGGGGSQVQLVQSGAEVKKPGSSVKVSCKASGGTFVRYAISWVRQAPGQGLEWMGGIIPIFGEAQYAQKFRGRATITADESTSTAYMELSSLRSEDTAVYYCAREGYYYGALPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSC

SEQ ID NO: 220 - protein, 689 aa, Artificial Sequence
  source: /note="Description of Artificial Sequence: Synthetic polypeptide"
QLQLQESGPGLVKPSETLSLTCTVSGGSISSSSYAWGWIRQPPGKGLEWIGSIYYSGSTYYNPSLKSRVTISVDTSKNQFSLKLSSVTAADTAVYYCARDSGRGYGDYGGHHAFDIWGQGTMVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKGGGGSQLQLQESGPGLVKPSETLSLTCTVSGGSISSSSYAWGWIRQPPGKGLEWIGSIYYSGSTYYNPSLKSRVTISVDTSKNQFSLKLSSVTAADTAVYYCARDSGRGYGDYGGHHAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSC

SEQ ID NO: 221 - protein, 689 aa, Artificial Sequence
  source: /note="Description of Artificial Sequence: Synthetic polypeptide"
QVQLQESGPGLVKPSQTLSLTCTVSGGSISSGGAVWSWIRQHPGKGLEWIGGIAYSGSTYYNPSLKSRVTISVDTSKNQFSLKLSSVTAADTAVYYCADENVRGYGDYGGHHAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCGGGGSQVQLQESGPGLVKPSQTLSLTCTVSGGSISSGGAVWSWIRQHPGKGLEWIGGIAYSGSTYYNPSLKSRVTISVDTSKNQFSLKLSSVTAADTAVYYCADENVRGYGDYGGHHAFDIWGQGTMVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 222 - protein, 687 aa, Artificial Sequence
  source: /note="Description of Artificial Sequence: Synthetic polypeptide"
QVQLQESGPGLVKPSETLSLTCAVSGYSISSGLGWGWIRQPPGKGLEWIGGIYESGSTYYNPSLKSRVTISVDTSKNQFSLKLSSVTAADTAVYYCAHERVRGYGDYGGHHAFDIWGQGTMVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKGGGGSQVQLQESGPGLVKPSETLSLTCAVSGYSISSGLGWGWIRQPPGKGLEWIGGIYESGSTYYNPSLKSRVTISVDTSKNQFSLKLSSVTAADTAVYYCAHERVRGYGDYGGHHAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSC

SEQ ID NO: 223 - protein, 689 aa, Artificial Sequence
  source: /note="Description of Artificial Sequence: Synthetic polypeptide"
QVQLQESGPGLVKPSQTLSLTCTVSGGSISSGGAVWSWIRQHPGKGLEWIGGIAYSGSTYYNPSLKSRVTISVDTSKNQFSLKLSSVTAADTAVYYCADENVRGYGDYGGHHAFDIWGQGTMVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKGGGGSQVQLQESGPGLVKPSQTLSLTCTVSGGSISSGGAVWSWIRQHPGKGLEWIGGIAYSGSTYYNPSLKSRVTISVDTSKNQFSLKLSSVTAADTAVYYCADENVRGYGDYGGHHAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSC

SEQ ID NO: 224 - protein, 687 aa, Artificial Sequence
  source: /note="Description of Artificial Sequence: Synthetic polypeptide"
QVQLQESGPGLVKPSETLSLTCAVSGYSISSGAGWGWIRQPPGKGLEWIGLIVHSGSTYYNPSLKSRVTISVDTSKNQFSLKLSSVTAADTAVYYCVLESVRGYGDYGGHHAFDIWGQGTMVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKGGGGSQVQLQESGPGLVKPSETLSLTCAVSGYSISSGAGWGWIRQPPGKGLEWIGLIVHSGSTYYNPSLKSRVTISVDTSKNQFSLKLSSVTAADTAVYYCVLESVRGYGDYGGHHAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSC

SEQ ID NO: 225 - protein, 687 aa, Artificial Sequence
  source: /note="Description of Artificial Sequence: Synthetic polypeptide"
QVQLQESGPGLVKPSETLSLTCAVSGYSISSGAGWGWIRQPPGKGPEWIGLIVHSGSTYYNPSLKSRVTISVDTSKNQFSLKLSSVTAADTAVYYCVLESVRGYGDYGGHHAFDIWGQGTMVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKGGGGSQVQLQESGPGLVKPSETLSLTCAVSGYSISSGAGWGWIRQPPGKGPEWIGLIVHSGSTYYNPSLKSRVTISVDTSKNQFSLKLSSVTAADTAVYYCVLESVRGYGDYGGHHAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSC

SEQ ID NO: 226 - protein, 687 aa, Artificial Sequence; identical to SEQ ID NO: 224
  source: /note="Description of Artificial Sequence: Synthetic polypeptide"

SEQ ID NO: 227 - protein, 687 aa, Artificial Sequence; identical to SEQ ID NO: 224
  source: /note="Description of Artificial Sequence: Synthetic polypeptide"

SEQ ID NO: 228 - protein, 687 aa, Artificial Sequence
  source: /note="Description of Artificial Sequence: Synthetic polypeptide"
QVQLQESGPGLVKPSETLSLTCAVSGYSISSEYMWGWIRQPPGKGLEWIGLIYHSGKTYYNPSLKSRVTISVDTSKNQFSLKLSSVTAADTAVYYCAREADRGYGDYGGHHAFDIWGQGTMVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKGGGGSQVQLQESGPGLVKPSETLSLTCAVSGYSISSEYMWGWIRQPPGKGLEWIGLIYHSGKTYYNPSLKSRVTISVDTSKNQFSLKLSSVTAADTAVYYCAREADRGYGDYGGHHAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSC

SEQ ID NO: 229 - protein, 687 aa, Artificial Sequence; identical to SEQ ID NO: 228
  source: /note="Description of Artificial Sequence: Synthetic polypeptide"

SEQ ID NO: 230 - protein, 685 aa, Artificial Sequence
  source: /note="Description of Artificial Sequence: Synthetic polypeptide"
QVQLVQSGAEVKRPGSSVKVSCKASGGTFSSYYISWVRQVPGQGLEWMGGIIPVPGTANYAQKFQGRVTITADESTSTAYMELSSLRSEDTAVYYCARAGGGYARGDHYYGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKGGGGSQVQLVQSGAEVKRPGSSVKVSCKASGGTFSSYYISWVRQVPGQGLEWMGGIIPVPGTANYAQKFQGRVTITADESTSTAYMELSSLRSEDTAVYYCARAGGGYARGDHYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSC

SEQ ID NO: 231 - protein, 685 aa, Artificial Sequence
  source: /note="Description of Artificial Sequence: Synthetic polypeptide"
QVQLVQSGAEVKKPGSSVKVSCKASGGTFSSYYISWVRQAPGQRLEWMGGIIPVPGTANYAQKFQGRVTITADESTSTAYMELSSLRSEDTAVYYCARAGGGYARGDHYYGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKGGGGSQVQLVQSGAEVKKPGSSVKVSCKASGGTFSSYYISWVRQAPGQRLEWMGGIIPVPGTANYAQKFQGRVTITADESTSTAYMELSSLRSEDTAVYYCARAGGGYARGDHYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSC

SEQ ID NO: 232 - protein, 677 aa, Artificial Sequence
  source: /note="Description of Artificial Sequence: Synthetic polypeptide"
QVQLVQSGAEVKKPGSSVKVSCKASGGTFSRGAISWVRQAPGQGLEWMGGIIPIEGTAYYAQKFQGRVTITADESTGTAYMELSSLRSEDTAVYYCARQSDYGLPRGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKGGGGSQVQLVQSGAEVKKPGSSVKVSCKASGGTFSRGAISWVRQAPGQGLEWMGGIIPIEGTAYYAQKFQGRVTITADESTGTAYMELSSLRSEDTAVYYCARQSDYGLPRGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSC

SEQ ID NO: 233 - protein, 675 aa, Artificial Sequence
  source: /note="Description of Artificial Sequence: Synthetic polypeptide"
QVQLVQSGAEVKKPGSSVKVSCKASGGTFSSYAISWVRQAPGQGLEWMGGIIPISGFTNYAQKFQGRVTITADESTSTAYMELSSLRSEDTAVYYCAREGGHYYSGWPYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKGGGGSQVQLVQSGAEVKKPGSSVKVSCKASGGTFSSYAISWVRQAPGQGLEWMGGIIPISGFTNYAQKFQGRVTITADESTSTAYMELSSLRSEDTAVYYCAREGGHYYSGWPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSC

What is claimed is:

1. An isolated antigen binding protein (ABP) that specifically binds human GITR (hGITR; SEQ ID NO: 1), comprising the following six CDR sequences:

(a) a CDR-H3 having the sequence $X_1X_2X_3X_4X_5$RGYGDYGGHHAFDI, wherein $X_1$ is A or V, $X_2$ is H, D, L, or R, $X_3$ is E or D, $X_4$ is R, N, S, or A, and $X_5$ is V, D or G (SEQ ID NO:141);

(b) a CDR-H2 having the sequence $X_1IX_2X_3SGX_4$TYYNPSLKS, wherein $X_1$ is G, L, or S, $X_2$ is Y, A, or V, $X_3$ is E, Y or H, and $X_4$ is S or K (SEQ ID NO:142);

(c) a CDR-H1 having the sequence $X_1$SISS$X_2X_3X_4X_5$W$X_6$, wherein $X_1$ is Y or G, $X_2$ is G, S, or E, $X_3$ is L, G, S, Y, or A, $X_4$ is G, A, Y, M, or G, $X_5$ is V, A, or is absent, and $X_6$ is S or G (SEQ ID NO:143);

(d) a CDR-L3 having the sequence QQEY$X_1$TPP$X_2$, wherein $X_1$ is A or N and $X_2$ is T or S (SEQ ID NO:144);

(e) a CDR-L2 having the sequence $X_1$A$X_2$SL$X_3X_4$, wherein $X_1$ is A or S, $X_2$ is D or S, $X_3$ is Q, D, K, or E, and $X_4$ is S or Y (SEQ ID NO:145); and (f) a CDR-L1 having the sequence $X_1$AS $X_2$SI$X_3X_4$YLN, wherein $X_1$ is G or R, $X_2$ is Q or K, $X_3$ is S, D, or N, and $X_4$ is S or T (SEQ ID NO:146), wherein the ABP agonizes GITR expressed on the surface of a target cell.

2. The ABP of claim 1, wherein the ABP comprises:

a) a CDR-H3 of SEQ ID NO:13, a CDR-H2 of SEQ ID NO:12, a CDR-H1 of SEQ ID NO:11, a CDR-L3 of SEQ ID NO:16, a CDR-L2 of SEQ ID NO:15, and a CDR-L1 of SEQ ID NO:14;

b) a CDR-H3 of SEQ ID NO:23, a CDR-H2 of SEQ ID NO:22, a CDR-H1 of SEQ ID NO:21, a CDR-L3 of SEQ ID NO:17, a CDR-L2 of SEQ ID NO:15, and a CDR-L1 of SEQ ID NO:14;

c) a CDR-H3 of SEQ ID NO:30, a CDR-H2 of SEQ ID NO:29, a CDR-H1 of SEQ ID NO:28, a CDR-L3 of SEQ ID NO:17, a CDR-L2 of SEQ ID NO:31, and a CDR-L1 of SEQ ID NO:14;

d) a CDR-H3 of SEQ ID NO:30, a CDR-H2 of SEQ ID NO:29, a CDR-H1 of SEQ ID NO:28, a CDR-L3 of SEQ ID NO:17, a CDR-L2 of SEQ ID NO:15, and a CDR-L1 of SEQ ID NO:36;

e) a CDR-H3 of SEQ ID NO:30, a CDR-H2 of SEQ ID NO:29, a CDR-H1 of SEQ ID NO:28, a CDR-L3 of SEQ ID NO:17, a CDR-L2 of SEQ ID NO:41, and a CDR-L1 of SEQ ID NO:14;

f) a CDR-H3 of SEQ ID NO:48, a CDR-H2 of SEQ ID NO:47, a CDR-H1 of SEQ ID NO:46, a CDR-L3 of SEQ ID NO:17, a CDR-L2 of SEQ ID NO:50, and a CDR-L1 of SEQ ID NO:49;

g) a CDR-H3 of SEQ ID NO:48, a CDR-H2 of SEQ ID NO:47, a CDR-H1 of SEQ ID NO:46, a CDR-L3 of SEQ ID NO:56, a CDR-L2 of SEQ ID NO:55, and a CDR-L1 of SEQ ID NO:54;

h) a CDR-H3 of SEQ ID NO:61, a CDR-H2 of SEQ ID NO:60, a CDR-H1 of SEQ ID NO:59, a CDR-L3 of SEQ ID NO:16, a CDR-L2 of SEQ ID NO:15, and a CDR-L1 of SEQ ID NO:14;

i) a CDR-H3 of SEQ ID NO:61, a CDR-H2 of SEQ ID NO:47, a CDR-H1 of SEQ ID NO:46, a CDR-L3 of SEQ ID NO:16, a CDR-L2 of SEQ ID NO:15, and a CDR-L1 of SEQ ID NO:14; or j) a CDR-H3 of SEQ ID NO:103, a CDR-H2 of SEQ ID NO:22, a CDR-H1 of SEQ ID NO:21, a CDR-L3 of SEQ ID NO:16, a CDR-L2 of SEQ ID NO:15, and a CDR-L1 of SEQ ID NO:14.

3. The ABP of claim 2, wherein:

a) the ABP of claim 2 a) comprises a $V_H$ sequence of SEQ ID NO:9 and a $V_L$ sequence of SEQ ID NO:10;

b) the ABP of claim 2 b) comprises a $V_H$ sequence of SEQ ID NO:19 and a $V_L$ sequence of SEQ ID NO:20;

c) the ABP of claim 2 c) comprises a $V_H$ sequence of SEQ ID NO:26 and a $V_L$ sequence of SEQ ID NO:27;

d) the ABP of claim 2 d) comprises a $V_H$ sequence of SEQ ID NO:26 or SEQ ID NO:34 and a $V_L$ sequence of SEQ ID NO:35;

e) the ABP of claim 2 e) comprises a $V_H$ sequence of SEQ ID NO:26 and a $V_L$ sequence of SEQ ID NO:40;

f) the ABP of claim 2 f) comprises a $V_H$ sequence of SEQ ID NO:44 and a $V_L$ sequence of SEQ ID NO:45;

g) the ABP of claim 2 g) comprises a $V_H$ sequence of SEQ ID NO:44 and a $V_L$ sequence of SEQ ID NO:53;

h) the ABP of claim 2 h) comprises a $V_H$ sequence of SEQ ID NO:58 and a $V_L$ sequence of SEQ ID NO:10;

i) the ABP of claim 2 i) comprises a $V_H$ sequence of SEQ ID NO:104 and a $V_L$ sequence of SEQ ID NO:10; and j) the ABP of claim 2 j) comprises a $V_H$ sequence of SEQ ID NO:105 and a $V_L$ sequence of SEQ ID NO:10.

4. The ABP of claim 3, wherein:

a) the ABP of claim 3 a) comprises a heavy chain of SEQ ID NO:7 and a light chain of SEQ ID NO:8;

b) the ABP of claim 3 b) comprises a heavy chain of SEQ ID NO:221 and a light chain of SEQ ID NO:18;

c) the ABP of claim 3 c) comprises a heavy chain of SEQ ID NO:24 and a light chain of SEQ ID NO:25;

d) the ABP of claim 3 d) comprises (i) a heavy chain of SEQ ID NO:32 and a light chain of SEQ ID NO:33, or (ii) a heavy chain of SEQ ID NO:37 and a light chain of SEQ ID NO:33;

e) the ABP of claim 3 e) comprises (i) a heavy chain of SEQ ID NO:38 and a light chain of SEQ ID NO:39;

f) the ABP of claim 3 f) comprises (i) a heavy chain of SEQ ID NO:42 and a light chain of SEQ ID NO:43;

g) the ABP of claim 3 g) comprises (i) a heavy chain of SEQ ID NO:51 and a light chain of SEQ ID NO:52;

h) the ABP of claim 3 h) comprises (i) a heavy chain of SEQ ID NO:57 and a light chain of SEQ ID NO:8, or (ii) a heavy chain of SEQ ID NO:220 and a light chain of SEQ ID NO:8;

i) the ABP of claim 3 i) comprises (i) a heavy chain of SEQ ID NO:114 and a light chain of SEQ ID NO:8, or (ii) a heavy chain of SEQ ID NO:120 and a light chain of SEQ ID NO:8; or (iii) a heavy chain of SEQ ID NO:122 and a light chain of SEQ ID NO:8; or j) the ABP of claim 3 j) comprises (i) a heavy chain of SEQ ID NO:115 and a light chain of SEQ ID NO:8, or (ii) a heavy chain of SEQ ID NO:121 and a light chain of SEQ ID NO:8; or (iii) a heavy chain of SEQ ID NO:123 and a light chain of SEQ ID NO:8.

5. The ABP of claim 1, wherein the ABP competes for binding to GITR with an antibody having a $V_H/V_L$ pair comprising amino acid sequences selected from the group consisting of SEQ ID NOs: 9/10, 19/20, 26/27, 34/35, 26/35, 26/40, 44/45, 44/53, 58/10, 62/63, 70/63, 71/72, 79/80, 87/80, 88/80, 89/90, 95/90, 97/63, 98/72, 99/80, 101/90, 104/10, 105/10, 97/63, 98/72, 99/80, 101/90, 104/10, 105/10, 126/128, and 127/128.

6. The ABP of claim 1, wherein the ABP blocks the binding of GITRL to GITR.

7. The ABP of claim 1, wherein the ABP is capable of binding to one or more of GITR (SEQ ID NO:1) residues from the group consisting of R56, C58, R59, D60, Y61, P62, E64, E65, C66, and C67.

8. The ABP of claim 1, wherein the ABP (a) specifically binds cynomolgus monkey GITR (cGITR; SEQ ID NO: 3); (b) binds murine GITR (mGITR; SEQ ID NO: 4) with an affinity lower (as indicated by higher KD) than the affinity of the ABP for hGITR, or does not bind mGITR; or (c) is capable of any combination of (a)-(b).

9. The ABP of claim 1, wherein the ABP multimerizes GITR expressed on the surface of a target cell, wherein the ABP multimerizes 2, 3, 4, 5, 6, 7, 8, 9, 10, 11, or 12 GITR molecules.

10. A pharmaceutical composition comprising an ABP of claim 1 and a pharmaceutically acceptable excipient, wherein the amount of the ABP in the pharmaceutical composition is sufficient to (a) reduce the suppression of effector T cells by regulatory T cells; (b) activate effector T cells; (c) reduce the number of regulatory T cells in a tissue or systemically; (d) induce or enhance proliferation of effector T cells; (e) inhibit the rate of tumor growth; (f) induce tumor regression; or (g) combinations thereof, in a subject.

11. The ABP of claim 1, wherein (a) the CDR-H3 has a sequence selected from the group consisting of SEQ ID NOs: 13, 23, 30, 48, 61 and 103;

(b) the CDR-H2 has a sequence selected from the group consisting of SEQ ID NOs: 12, 22, 29, 47, and 60;

(c) the CDR-H1 has a sequence selected from the group consisting of SEQ ID NOs: 11, 21, 28, 46, and 59;

(d) the CDR-L3 has a sequence selected from the group consisting of SEQ ID NOs: 16, 17, and 56;

(e) the CDR-L2 has a sequence selected from the group consisting of SEQ ID NOs: 15, 31, 41, 50, and 55; and (f) the CDR-L1 has a sequence selected from the group consisting of SEQ ID NOs: 14, 36, 49, and 54.

* * * * *

UNITED STATES PATENT AND TRADEMARK OFFICE
CERTIFICATE OF CORRECTION

PATENT NO. : 10,988,545 B2
APPLICATION NO. : 15/900168
DATED : April 27, 2021
INVENTOR(S) : Daniel Hicklin et al.

Page 1 of 2

It is certified that error appears in the above-identified patent and that said Letters Patent is hereby corrected as shown below:

On the Title Page

Replace the title page with the attached title page showing the corrected number of claims In the Claims At Column 176, Line 65, Please add the following claims after number 11:
— 12. An isolated antigen binding protein (ABP) that specifically binds human GITR (hGITR; SEQ ID NO: 1), comprising: a CDR-H3 of SEQ ID NO:13, a CDR-H2 of SEQ ID NO:12, a CDR-H1 of SEQ ID NO:11, a CDR-L3 of SEQ ID NO:16, a CDR-L2 of SEQ ID NO:15, and a CDR-L1 of SEQ ID NO:14.

13. An isolated antigen binding protein (ABP) that specifically binds human GITR (hGITR; SEQ ID NO: 1), comprising a VH sequence of SEQ ID NO:9 and a VL sequence of SEQ ID NO:10.

14. A pharmaceutical composition comprising the ABP of claim 12 and a pharmaceutically acceptable carrier.

15. A pharmaceutical composition comprising the ABP of claim 13 and a pharmaceutically acceptable carrier. —

Signed and Sealed this
Twelfth Day of July, 2022

*Katherine Kelly Vidal*

Katherine Kelly Vidal
*Director of the United States Patent and Trademark Office*

(12) United States Patent
Hicklin et al.

(10) Patent No.: US 10,988,545 B2
(45) Date of Patent: Apr. 27, 2021

(54) ANTI-GITR ANTIGEN-BINDING PROTEINS AND METHODS OF USE THEREOF

(71) Applicant: Potenza Therapeutics, Inc., Cambridge, MA (US)

(72) Inventors: Daniel Hicklin, Montclair, NJ (US); Cynthia Seidel-Dugan, Belmont, MA (US); William Winston, Newton, MA (US); Jose-Andres Salmeron-Garcia, Westminster, MA (US); Heather Brodkin, West Newton, MA (US); Sonja Kleffel, Boston, MA (US); Nels P. Nielson, Lebanon, NH (US)

(73) Assignee: Potenza Therapeutics, Inc., Cambridge, MA (US)

(*) Notice: Subject to any disclaimer, the term of this patent is extended or adjusted under 35 U.S.C. 154(b) by 0 days.

(21) Appl. No.: 15/900,168

(22) Filed: Feb. 20, 2018

(65) Prior Publication Data

US 2018/0208665 A1 Jul. 26, 2018

Related U.S. Application Data

(63) Continuation of application No. PCT/US2017/062443, filed on Nov. 19, 2017.

(60) Provisional application No. 62/448,644, filed on Jan. 20, 2017, provisional application No. 62/497,428, filed on Nov. 19, 2016.

(51) Int. Cl.
*C07K 16/22* (2006.01)
*C07K 16/28* (2006.01)
*A61K 39/00* (2006.01)

(52) U.S. Cl.
CPC ...... *C07K 16/2878* (2013.01); *C07K 16/2875* (2013.01); *A61K 2039/505* (2013.01); *C07K 2317/34* (2013.01); *C07K 2317/35* (2013.01); *C07K 2317/51* (2013.01); *C07K 2317/515* (2013.01); *C07K 2317/55* (2013.01); *C07K 2317/565* (2013.01); *C07K 2317/75* (2013.01); *C07K 2317/92* (2013.01)

(58) Field of Classification Search
None
See application file for complete search history.

(56) References Cited

U.S. PATENT DOCUMENTS

| | | |
|---|---|---|
| 6,503,184 B1 | 1/2003 | Ni et al. |
| 9,028,823 B2 | 5/2015 | Smith et al. |
| 9,376,494 B2 | 6/2016 | Li et al. |
| 10,487,147 B2 | 11/2019 | Nastri et al. |
| 2005/0014224 A1 | 1/2005 | Collins et al. |
| 2006/0002932 A1 | 1/2006 | Vieweg |
| 2006/0134102 A1 | 6/2006 | LePage et al. |
| 2007/0098719 A1 | 5/2007 | Smith et al. |
| 2009/0136494 A1 | 5/2009 | Ponath et al. |
| 2013/0183321 A1 | 7/2013 | Smith et al. |

FOREIGN PATENT DOCUMENTS

| | | |
|---|---|---|
| EP | 1955708 A1 | 8/2008 |
| EP | 2343320 B1 | 10/2017 |
| WO | WO 2003/006058 A1 | 1/2003 |
| WO | WO 03/068257 A1 | 8/2003 |
| WO | WO 2004/058183 A2 | 7/2004 |
| WO | WO 2004/107618 A2 | 12/2004 |
| WO | WO 2005/007150 A2 | 1/2005 |
| WO | WO 2005/007190 A1 | 1/2005 |
| WO | WO 2006/105021 A2 | 10/2006 |
| WO | WO 2007/060918 A1 | 5/2007 |
| WO | WO 2009/009116 A2 | 1/2009 |
| WO | WO 2017/096179 A1 | 6/2014 |
| WO | WO 2015/184099 A1 | 12/2015 |
| WO | WO 2016/110267 A1 | 7/2016 |

OTHER PUBLICATIONS

Paul (1993) Fundamental Immunology, #rd edition, pp. 292-295.*
Bendig (1995) Methods: a companion. Methods in Enzymology 8:83-93.*
MacCallum et al. (1996) J. Mol. Biol. 262: 732-745.*
Casset, Roux, Mouchet, Bes, Chardes, Granier, Mani, Pugniere, Laune, Pau, Kaczorek, Ll.hana, and Rees. A peptide mimetic of an anti-CD4 monoclonal antibody by rational design. Biochemical and Biophysical Research Communications, 2003. vol. 307, pp. 198-205.*
Skolnick and Fetrow. From genes to protein struchue and function: novel applications of computational approaches in the genomic era. Trends in Biotechnology, 2000. vol. 18, pp. 34-39.*
Wu, Nie, Huse, and Watkins. Humanization of a murine monoclonal antibody by simultaneous optimization of framework and CDR residues. Journal of Molecular Biology, 1999. vol. 294, pp. 151-162.*
Agostini, M. et al., "The Glucocorticoid-Induced Tumor Necrosis Factor Receptor-Related Gene Modulates the Response to Candida albicans Infection," Infection and Immunity, Nov. 2005, pp. 7502-7508, vol. 73, No. 11.
Baltz, K.M. et al., Neutralization of Tumor-Derived Soluble Glucocorticoid-Induced TNFR-Related Protein Ligand Increases NK Cell Anti-Tumor Reactivity, Blood, Nov. 1, 2008, pp. 3735-3743, vol. 112, No. 9.
Barbee, S.D. et al., "Development of FPA 154, A Novel Tetravalent Anti-GITR Antibody, for the Treatment of Solid Tumors," FivePrime® INHIBRX, Five Prime Therapeutics, Inc., 2017, 1 page.
Baumgartner-Nielsen, J. et al., "Glucocorticoid-Induced Tumor Necrosis Factor Receptor (TJGR) and Its Ligand (GITRL) in Atopic Dermatitis," Acta Denn Venereol, 2006, pp. 393-398, vol. 86.

(Continued)

*Primary Examiner* — Michael D Pak
(74) *Attorney, Agent, or Firm* — McCarter & English, LLP; Maria Laccotripe Zacharakis; Joseph A. Ciardi

(57) ABSTRACT

Provided herein are antigen-binding proteins (ABPs) that selectively bind to GITR and its isoforms and homologs, and compositions comprising the ABPs. Also provided are methods of using the ABPs, such as therapeutic and diagnostic methods.

15 Claims, 79 Drawing Sheets

Specification includes a Sequence Listing.